United States Patent 10,226,492 (PROBIOTIC AND NEW BIOMARKER) - sequence listing, part 2

SEQ ID NO: 86 - DNA, 6767 bp, Lactobacillus plantarum
tttctgccaattgccggaacgcggtgggcacagatttgagccgaagcccacgtcttaaatactggcctttcacgcttttatgccatattggtgaaacgtgttcgggtcagactgagacttcacactcttgcagtactgggcattgtcagaaacaccttccagtcgggatggtattcgaatagctgatgaagatgtactcaacttttgatgaattggtcgttgtttttcataaacggtaattttctcaatcaactgtcaggccgaaaatgatattgtgatgacttactatttctgagttaccagtcataatacattgaacgtttcgacaaagtagagattacattctgatgtttcgctcaaagttttcgtatcaaagtagtcagcaaccaattgtaccaagttaagcggccgtttatttgccattcgagcggcttcccgactggaggggctgggtgacaatgctcagtagccaaattattcttagccggaagtgtctttcttccggcttagaataagactcgtatttgagatgacgcgggttatgcgttagctcaaatcgacgtcggcttacgttccagcaattgtcacccagtcccggaggtcggaataggatagtcattgcagacgaacagaaatctatctaattggcaccttttaaccatgattcttactaaacaaccagccagtacgatgcagacttaaataatcaatcaaactcaattaactggatcgtcattttcatgctatgggtataagtttattttaccattattaatcattaaagcctttaaatcaccttggctttaccgattttttattatttcctatttattggtcgaaccgaagcccccagaacgtgtcgttgtcacattcgtttcatccgtaacagtcagataaggggtaaaaatcccttgggcaatgcgttcaccctttttaatgtgaacgtcgcgaatccccatgttgattaattggacgaaaatcgcaccttcgttcttgggattgttatagtagtcagcgtcaatgacgccaatcccattcggtagaatcaagttacgcttcaaggggttgctagaacgattggctaatagtaagtattcaccatcattcataaatgccttaatacccgttggaacaagccatggtttaaggactttagccgccgcatccaaatcggctgcagaactcgtttcaccatgatgtatttgccaaagtactttgataaagttcattttccaaattgacggtaacgtaaaatcttccgccgcttcgaagtcatagccagctgcttgcttggtagtgcggtaaggtacatgtaaccccgcctgcgcgtattgacttacaatttcaaatccccgtgccatttcaaattcctactttctcaacattaatttagtgttcacattttaccatacttttattatagaagtttcgttgacaaaacgggcaattaccggtttaattacggtagatataaaaccctttacaaggtggtgaaatcaatggaattcacgcgtgaagcacaccgcttttattttaatgacgatcacggcaagttggctggtgaaattaccttccccgccatcaataatgatcagacctgggtcattgaacatacctttgttcgtgacgattttggtcatcagggcattgccggccaattaaccaaagccgttattgacgccgctcgagttgaacacaaacgtattcagccactgtgtacctacgctaaggcttactttgatcggcaccctgaagctgccgacgtattagtcactagttctcaatcaaaggagtaattcatattatgaatcaggatcagttaaaacaacttgttggtcaaaaagccgttgaatacattcaagacggcatgcaggtcggcctcggaaccggctcaaccgttaaattcatggttgatgctctgggtgaacgggtcaaaaatgaacatttaaacattgtcggcgtctcaacctccgaccgaaccgctgcccaagctaaggcgctcggtatcccgatgaaatccgttgacgaagtcgaccatctcgacttaacgatcgacggtgccgacgaaatcgccgatgatttccaaggcgttaagggtggtggcgccgccttactcttcgaaaaaatcgttgccatcaattctgataaagtcatgtggattgttgatgaaagcaaaatggtccatcaattaggtgcctttggcttacccgttgaagtgattccttacggcagccaacatgtctttgaaaaaatggctacccggggctataacccagtattccgtaaagtcaacgatgaactcgtccggaccgattctaataatattatcatcgatttacacatcgacccaatcacggatccccacgctttagccgaagatttaattcacatggttggtgtggttgaacacggcctgttcttagacatggtcaacactgtcattgtcggtcatgccaatggtcccgaggttatcgaagcgcgaccatagttttgtgcgactccccgcttgccccacccgtcataaaccgatacaattagaattagattaaaggagagtgatcttttgagtaaagcaatcagtatgaaccaaattgctaactttcaagccgacttggaccaacgtcccgaagcaaaagtcatcgaacgtagtgtcactaagaacggtatcttagcaagcagtcaagatattcaggccatgagccaaaccacaccagtattttccattgatttggatacaggtgacgttgcgaaccaaaagcaaagtggccgttgctggatgttcgccgctttaaacacgatgcggcattcattagctgaaaaattcaacttgaaacatttcgaactatcacaaaactacacctttttctgggataagttcgaaaaagcgaactatttctatgaaaacgtgttggcaaccgctgaccaaccaactagcagccgtaaagttgcctggttgatgaccacgccacaacaagatggtggccaatgggatatgctcgttgccattattcagaagtacggtatcgtgcctaagagtgtcatgcctgaaacttacaacagttcaaaatcggctgaaatcaacagcacacttaacttaaaattacgtaaagatgccgttgaattacgtgaactagtggctgccggaactagtgacgacgcgattcaagaacgcaaggaaaaaatgttaaatgaagtctatcgcatgttagcctatgcctttggcgaacccgtttcacattttgactgggaatatcgtgatgataagaaacaataccacatcgaccaaaacttgacgccacaaagcttcttcgaaaagtacgttggctggaatttggacgattacgtttcaatcatcaacgccccaaccgacgacaagccttataaccatacctacacgattgaaatgttaggtaacgtcttaggtggccgtgaagtcaaacatttgaacgtgtctatggccgacttcaagcaattggccatcaagcaattacaagctggccaaagtgtctggtttggttgtgatgttggtcaatcctccgaccgccaaaaaggggtcatggctaccgatgtctacagtaaagatgaattattcgacgttgacctttcaatgtcgaaggctgaacgtcttgattacggcgaaagtctgatgacccacgccatggttatcaccggtgtcgacctcgttgacggccaaccaactaagtggaaggttgaaaatagctggggcgacaaagttgggactaagggcttcttcgtcatgagcgatgcttggatggacgaatactgctaccaagttgttgttaacaaggaattcttgtccgatgacttaaaggcagcccaagccgaagaaccaactgttttagcaccttgggatccaatgggtgcattagcctaattaagtttaatgggccatctaaattaagcaccatcactgctttagcgtgatggtgctttttggactgcattagacttaactaccgctcaaggaactactaacaacaaacaataaaaaaatcgaccaaactcgcgtgagtttagtcgatttttttattattacgtttacttatagcaatcactattataattatttatacatctgcttaagcgtactaatctcacgagtcgtgatatgtgctgctcgatgcgactggtaatacatcaccgcactcttgttgttctcgtgctctagtcccagtgcatgtcccaattcatgggtcgcaacggacagcttatattctaccgaatgattgctggctggaaagcgattcgtgtaaatcacacacttcgccgaatccatccaagttgctccttgcgaaccactttgatagtacgtccgccaagtccggccgatttccgatccggtcgtctccgtctcgtcttcactctcgcccaacgtaatctgggctttcgcttggtccttagcctcaactaacctcaccgcgttagtgttattccaacgttccacggctcgtagccaaatcgctcgatacaccttgctgtcactcgtgatccgatacgtgatgacccgactcttaaaacgggccttatagttcaaaaccttagtcccgttatttatataatcatattgatagttatccatctgatcattgtagtagacctgatcatgcgtcgtatcgtgaccactagccttatccgcttcaactcgcgacgcattcgggttgatcagcgtactgatttgtggcgcaaacatcaacagcatcccgcagaaacccaagctcattataattaataataataaatttttatgtttcatcataacgttacccggctttctgatcagatttttggctgtcaagcgcgccaaatcgcaactttgtccatctgatatgttacagcgttcaccattctattacaagttatatattatatttatttatgaaaactgaaggattctattacattaaaaatatttatattaactcaaacagttatgaaagcactgttatatcaacttttttaagcctgtatcattttttgagtactcgtcggcaattattatcaatgattataattacttatactgggcatttatttaacactttaactaaaaaaagagcttcagcgtctgctgaagctcttaactcaggctcgattaatctgataatggtctaaaaaagcagtccagattagcacttactttcaataaaagtaccgcttaggagaactattactaaatttaatactcttctttaccgataacgtgcagttgctgatcaaggtgataacaaattggcaccccgttagcaacttcgacaccatcaatcccagtatcactaatatgctctaaatatttgatcatcgcacgcaacgtactaccatgcgccaccacgagttggttttggccgtctaacagccgcggtgcaatctcatcgatccaataaggcatgatgcggtcgtaagccatcttcaagctttctccccgcggttcgacggcggcaccgtacttggtgtaacgtcgatcatggtctagttcagctggtgtcaacaacggcggcaccgtataaaagctccgccgccactgttgaacttgcgccttaccgtactcttgacgagtcacatccttattttgaccacgtaaggcaccgtaatgtcgttcatttaaccgccacgtcttatactcaggcagccataactgatcaatttcacttaacataatattcgcggtaacgatagcccgttttaggactgaggtatgcacagcgccaaactgcagtcccgtagctcgtaatcgcttgccagcttgatgagcctgtgcaatacccactgctgttagcgggacgtcactccaaccggtatacgtattatcccgattggccgtactctcaccatggcgaaccaatactagttctgtcattctctttcccacctactatcttcaatacttcctatgataatcgatttggttcatttttcaaagtcacaaccagctgttacgtgcgataacgcgcttgccacaaaaaaacggtcaagctgattaatatcaccctgaccgtccacgattaattaattttcttgatttgaaacggcgtgcgcggctttgatgacatgttcatcatcataggcggccgctgttggctgctcaatcgcacccatcgtatcccgttcacggaaccgattaccgacaaaggtcacgacggaaccaatcaaaatcacaacaattccgaccactgtcgtccacaaaatttgttcatggaggattaacgctgctaagattggcgccaaccccggcttaatgaagaatactagggaagccgttgaaacatcggtttgttccattgccaagaaataaaacgcgaagcccccaccagtaacacaaacgccgataaaaaatagtaaccagaaatagttgagattaacattcaccaaaaccggaatggcagcaaattgccgcaaaccgatggccgtcaacccattggcgacagccggaatcttagtaatccaagctaaaactagaagttcaaacgcaccagcaaagaaagtaaaacaagtcatcgtcagcccattcaagccccgtttaacagacccataacgcgagatgatactgtacagcccaaaagtcacggcagacccgatggctaatagcagcccgagcccattcgtcaaatgggccggattaacaatgatcaacaacccaatcacagaaatcacgacggagatcaagttagctcgacccaaccgttctcgcagaattaaataggagaataatagcgcaaataccggattacaactaagaacgtgtttagaat

SEQ ID NO: 87 - DNA, 10572 bp, Lactobacillus plantarum
gacaaaatgtagtcgataaacttctgtacgccttgggggagtaaggcgcaatagaggtctaaaagaggtttaaaagaggtttataaaagaggtttaaaagaggcaccactgtacaagatcaaaatctaaaacaaaaatacaaaggagtgagcccaaaaacaggctcacactaaactccagtcgctatgctccttgcgcctcactctgttcgttgcccaaaaggtgtggcaagccacattaattcgggcgctgacgccccgaaccccgtccaagctgagccagcttgactgctttttcactcgccgttaggcaggaaagcaaagttgtgtagaaactttggctttcgccatttcagtgtaaagactggttaagagctgtcaattccttatgctcccacgctgcgctcgtccgctaccattgacagcaaacagttagtttttttgaatcttaacaagaatctaactgctatattcgtttttaaaggccttatttctcgtttctagagattttgagactgtttatatatatttataccaaagcaaaaataaaaagccctcagcaggctcttagagggctaaataacgaagccaggacgattaataatatcttcttgtcttttttgcaaaatataagtgtataaggaatcatacaaattctttttaatctcgtcaggttcattgacagaagcttcaaacaattcttgaatatcaacttgccaaggatcagcaagcatttcatcaattggttttaatactttcttttcgtcaatcttaatgactcctaacattaaaataatgatttcagtttagatacgcagttcttacagttagttattcaaattttgttgccaggtttatgaagattctctgcataaagcaattaaaaattttggttgaaagcagtcggaaccgctggaggaatccgtggctggagattttttaaagaagctcaatttggataggagtaagagacaagcttacaaagaacgagaacagtcggttgggtataaccaaagaggaccgaaactatattgactatgaatgtaaaatatgttttactaagtttgtcaaagatgtttgacatgaggacgtgaatattgatgaaaaataccattgccactcggcggaaacagcggaaattgtcacaagccgaattggcccaactgaccgctgttacgcgacaaacaattaatgcgattgaaaacaataagtatgatccgtcactatccctcgcattcaagttagccgccattttagagaccacggtcgatgaattattcagtaatggggaggatgtcaaatgagtcgtgctaaaaggattcttcggtttacattttgggtgaacaacctagtatttttgttgctagctgcactgattattgtcagtttcagtcatctgttttatatctgggcaccgattatatcgctcgtgttggtggtcacctgtgtcgcgatgctctggtacatgcggcaccaactcggcgtcaagtcatttaaaggcctttactgggttgatgacgaacgtgatcggctgattactcttaaagttcattccacagttatggtcagtgccacttattttctatacggattgctcggcattatctgcttactgttgaattggcgcctctcgtctcaggaactgggacaaacgctcctagcaatcatttggctagccctagttgccagcaatctacaatactattggctatggatcaagtacgatcaggaataatttttttttattctgtgttactttccagataaaataagctgattctatagctaccagtagaccgagtgaaacgaggtcaatgcgcacttacacgtcatctaaaatgacgttgtgctaaaatctaaaaaatctgtatcagaagtcgctgtaagcgacaactaaaagcaaacccatttaaccaaaatcaatttgatctaacatactttcggtacttgcttggtctaagcctaaataagctagagtcatggcttcacttgaatgatttaataagtgcatgactaagccaatattgtaattggattgcgtataaacgcgataagccccggttttgcgcatcgtatgggtccctagataattaattcctaacagatcgccaaccttactcataattttgtagaactgtttttcagtaatatggcgttctgggtgttgaattgaaggaaagagccattcagaatccagcttatgatcaagcagccattgacggtacaataagagctctgtttgaacaggtttaaggtacaaggtattaggtttaccagtttttcggtcatgaataaacgcattttgtttaatagaaccgtccggattaaaaatatcggcctgttttaagcgcatgacatcactgactcgcagcagtgtcgctttgccaacttgaaaaactgtatagttacgccggccagctttaaagttgttgagtaaggtatcttgaacctccttgagaacatttgaatctttgatgggtaagacaacttgttgcatagttttagctccttaaaaaattgatttttagtacaaattaaagtacaatattaagtacgatgaaagggtggtaaatatgacattagcactaacacagagcgattttcgcgctaacctaaaaaaatatttagatcaagttaatgacgaagacgaaaccgtttatattgctcgttcaaatagtcgcgcagtagccatcgtttcacaagaaaaaatggactggctagaaagagcattaaaagctaaagaaggttcgttagaatatgcaattgcacgtgatcagttaattaaacgccatgttttacctgacgatgaaattgttgaatcagatgatgattattggggtcagtttaaataatgaaaaaactaagatttaaaccacgtgcaacctttaatgctgatctaaaacggttagccagtttagacaaatctattattgatgaagttcgagcagccattgacctgttgcttgagcaacaacaattaccatcagaatttgaagatcatgagcttaatcggcgaatgagcggttataatgaatttcacttacgagataccccgaaaaacaaaacaccaagcgaaactaacgatgtcctggtggtttatacgattgataaagatgaactagtcttaattggcattcgagtcggatcgcatgatcgtttatttcctggtcaaaatcgtgctaaaaggtatcgaaaaaatgacaaatagaagaagttatttttataatatgaaaataaataacccctaatatctacattatagatattaggggttattctttcaatgttttcgaggggttatttgatagttatagaccctgatttagttttactttctatgcttaacaaatagcagtaagacaagttggatcaagatgataacaataaagaaaaccactagcacaataaaagcagctaatttagttgctggcgtttgaatcgttccagcaccagcaacttttctaatgaaaattacaaagcttaatatactgaagatgattagccaaataagattgcttagccaccaaacttttaatttcatgtgtttggggttactccttcttttggtagtaatatgtactaactaattggcataatagaattatactggtcagaaaggcagccgtccatatcgagccaaaacagccactattcttaaaaatctccgcgataggatatatatcatatgttgagagacgtgttctaagccctcgttcagtgttcaccttgattaactatgttaatataaacgtatagactaacgtaaaggatgacgtaaaatggcaaataagacaatatcttcaatagctaaagatttgaagatatcacgtgcaagggtttatcaaatcattgatatgcttgatgacaacgaaaaaccctcaaaagacagcaatgatagatatgtaattgacgatagtgctgtcaatgctattcgtaaatactatgcaaatagtaacaccaaggctaaacaagaaaaaacgtcaccaattgacgataaagttcttgatataattcgacgtcaactagacaaaaaggatagacaaattgaaaagctaactcaattacttgaccagcaacaacagctcaatttgtctactaaccgtcaaaacgaaaaattacttgatacctctacgaacaacaccccctcacaggacgatagcccctcgcaaaacgacgatacagacgttttaaagcctaccgagagtaattctaagtgggaagaaactaaaacgcttaaaaagggcttattcggctggctaagacgttaaaaatacccctttgtcatattatcggcaaaggggtataatactgtttgtaactaaattgaatagacaaaaaaattccctcggtcgccaccgggggaacacataacccttatcaaagtttatgtgttcattttacctactattgtaagatttttcaagtaggtagagttgaatttttctggatcacgggggagccaagccccgttactagagtggcaacattctagccaagccaactaatcttacctttcgaggaatgacagccggttagcggagctaatgaaacaagtcgacaggtcaagtgagagccgccgctataaactcccactaggaattaacctatacttgtatttaggttggttccgaacggtggccccacgtacggggcgggcggtaaagcagtacgaaagtacagggcgattacgcaaggccagtgatccaaacaactaaaaataaatgattgctggcacctataaagggtgctttttttataggctaaattagttaggctaatctacaagcgtaatagtaacaatacaagtgtttttacgtgacggtgattcgtgacgaacaacaaaaagttttcttcttcgcaaaacaaggggaaaactatatcccgctcaggttcaagcgctctgaacagcaaaggtcgagaccaaagtcaagttagttttaaatattttataggttttatggggattagggggagctatttttgagtaagtttgcgattaaaaatcattggatagaagttgtcttggttgttttactagttggggttacaattttaagtattgggtggcatatttatcggtatggtggtgattattactacatgcgagtgaatggtagtagtgaatcatttcctgtaacagttccagttgggattacacagaacggctatgtttatcgtggtattgctaaagataagtatgggaatcggcaacggctagaggttcaaacggttgctgatgatttagggccatttcataagggacagatcattagaattacatataatcctaaatttggtgtgactaattataagaaagttagccgtgatcaggttccaccattggctagaattcactaactttcctaaaataagaatgctgttaaattagcctttcatcttatcgcttcacctagaccaatttgaattcacaaagtaaagaataagtacccctgctaacgtcgtgttagtgagggtactttgattaatggggattatattaattactggttaggaagtcctaaagctcataagtatgggaaaaatgtgacaatcacgaaacaagatattttgtggggtaatctgacatttacttctagaaaagcagacaaagccaccatcggaaatgactattctgcaaaatatatttacaataatccaaacggaagttcttacttgtcactttatgataagaacagcaaatgggctggatatattaataagagtggctcaagggacttagtacctgtttcatacaataaaaatgtcactattgtcactaagaaccaatggttctgggggagacttattgtggaaaactaagaaacattccacaaatgattatcttaatcaaaccctaatggctaagagataggtagcgtcaagaatcttgtgtaaatgaaatgccttcgtacatataatatgtatctaacttaaataaatgatgcttccaaggtgtcctggagtccttggaaccctcggtggatccgcttcagagacttctcgttataaacattaaactgagaaaccaggaagcgatccagtgaatcttccgttggaaattgttctttgtggtgggtggtgcgcttgagatgcttattaaagttctcaatcaggttagtggagtatagtgattgccggatagctggtggaaagtccatgaaagtgagtaaattcggcattttaagcagatctttgattaatttgggataggtctgatgccagttgttggcgaactcattcagtttcagttcggctgcttcacggttggcggcccgatgaacttgtttaaagtcactgatcacggccttgcggtcttttacgcgaactttgttcatcagattccgcccaacatgaaccaggcaacgttgtcgtttggctttagggaaatgccgattcaagccttcatccaaaccaactaacccatcggccacaaacaacagcacatctttaacgccctgcttgatcaacgttcccagcagttcagtccagattccagtcgattccgttggcgccacttggtagttcagcacttctttcgtaccatctggacgaatgccaatcgcaatatgaacggcttctttttgaacggtatcccgctttaacggcaagtaagtggcatctaagaagatggccgcatattgtgaagccagtcgacgttgctggaaagcttgaacctgttcattgacggctttagtcatgttggaaaccgtggctttggagtagtgagcaccgtacattttctcaatgagttcggcaatttcagcagtggtaattcccttggtatacaactgaatgaccgttgtttctaaattatcactgtgccgaccgtaggctggcaaggtatgattttcaaaccggccattgcgatctcgaggaatggttaagttaagttggccgtacttcgtatcaaacgagcgctcataactgccgttgcggttattaccagtgttaatcccagcgtatgagtagcgttcgtaacccaaaaactctgccaattcggtttgaagcagctggttaatcgcaatttcgaggtggtgacgaaaaacttcgtccaaatcttgcttttgggctagtgcagcgataatttctgtggtaagttcattcatggggaatgcctcctgtgatgttttctgtggttactaaatatcataagggaaggcattccctatttctatacaattcagaaatcttttatgcatttacacaagatattttacgctctcaagagatattatacgcttggtaacggcaaacgtttttattcaatctactctggtgatacttggctaggatacgtaaactcagcctatactaaataaacagcgacaaaaaatgattttatcatcgaaaaaaaagcttgagagattactctcgagcttttttagttaacactaagtactatacaaatatcaagtgccttttggacacaaacacgcaacccattttaaatgttcttaccgaataaaaataactttcaaatactaatccagatttcaaattaggttgttttgagatgtgtttgtctccttataaaggaaaaaaattgaaaaataactaaaattattaatgttgaaattgacactaagcttgcatatttttgaacatccgttcctctataccaaatgtgaattattcctgagcgttttggataaacacaaatttgatgattcttagtttgtcttatctttaattcatgcttgttttcagtcgctgcataccctggatacatcaataatggcacaaccagcttaccttcatttgaagtttttgataattggtatcttattttaaactcattcaactttctactaactcttgtcgtccgaccacgtaatgctttcacatcgtttgacaaaaattgctgtttggtaccaaccggtaaatattccttaccatttccaatttgcattgaatcaatagctgtttgactattaacaaatttttcatatgattttctagttggtgacgtgattgaaaaaattactgaaaaatccataaataagatgagtactatagccagtattttatatatctctaatcgtctccccttacttttatagcattgaagttcaccgtatatatacatcccgcttccaattgctaacagtaacgttgcaaatacatttaatctcaatgggtattgtaaaaatgcaagtttcgtataatcaagtaattgctcccaaggcaaaacatttgtagagctgatagcaataattattcccaatatgataaaacgatcaccatatataagccatttttgcttatggcacataataattctaattcccacgactaacgtaaaaataatacccaaatttgtcgattcaagagaatttgcaaacgtacctgaaaacagatcaaaaggtgacttaataaaatgattaatatttccaatttctgatgcattgatgaacattggcactcgcttaagttgttcaagcatgggcaaaagaaatgttgctgataacaaaaagctcacaacgctagctttaattagatttactaaaattaatttattttgaagaacttttttcacattaaaaatcaaataaaaaagtaacattatgccacacattaccgtagtgattaagtgcgtataaacaagcaatgtcattcctagacacaaacataaccatccatgattacttgcattcactaatcgatacatacccaataaaactattggcaaaaagatcatagcaaccccttcacctaacgcatttctcaccagtaactcatattgataaaaaatcgatgtcatgtataaaattgcaattaagtatgcaagtagttgttttttggtaaaagtccacgcacacacatacgtgataactagccccgaaaaagtggtaatcattatcagtatcttgtacaaagttaagtacgaaaagctgaacttagcccaaaaaattaacggataaaatattaaattgctataaaacataggtgaagcatagccgttataattcaaaaaagttactgcaatccttggaaaatactgttgatgttgaactgaaaccaaaaagctcttcaacctattcatgtgaaagaaaaagtcagaactaataataacaggatatttttttgtgctccataaggaatacgaaaaaaggatcgtgattaatccgaaacttactataatgccgaataattcccaaatattccttttatttttccttacatttttaaacataattcgaaccacaaacctttcagaaaatgaattgaagcaacacattatagttattaatttacaacacgttcgtaaaactcatgcatagcttcatcattatatttatcaaagtaaaatttgctcctatcctagtatttggtacataaatttctgttaccaatgttactagtaaataatccgccgtcttgtttttgattgttaccaccaccaaaatgctgttttaaaagcaaataacctgaattggaaacaactaacgtttgtacaaaccgttcctagtcacggtttgtacatatttttctctaaagttttcatcgagttttttcctaatggcttgttttgatacatcaaattcgtcagcaagttccttaattgttttaggcattgtttccaaaccccttttggagttcagcaagcatttcttgtcttgtctgatctcttattgttttatcatgctcaatctgtcgttcggctaaaatctgtttttcagttgagcctagtggtaggcctttaactttatcggtagcacgccatttttcttgttctgttaattcaccattattctggatattaaaaagtttttgacgctcatcttggaacttaccttgagaaaagtcgtttgcgtcttttctttcaggcttccaggtaaaagaatacccaatcactggtttcccacgacctttaccatatttttttcgtatagttaggcctctaaacaaaggggttagttcttccttaattgggcgaataaccctagattcaacgttcgcaggcttactccaatagctttgtggaatatctagtagttcaaagaaatcatttttagaaaaataagcataaccagtggttcggaattgtttaagaatacgaaaagttgtttttgcgtaactactctttaaatctcggaactctgtcaacgcataacgaacccaactttcgagattatttagaagtttcaacgctttgggataaatttgaatatcaacataaggaacgtctgcagatcccttaatttcaaatcgagtgaacatgacaaacatctctctatcaagaccatctttacttcgagagccaaatctaagacctagtattttttgatatgtactttgtacgtcatcaataaaccgattatttgcggttggcttataggcacttaactcttttaactgatcaaaggtaaatctaacagtatcatcacctttatcacgcattctagaaactacagaaaagaacaagttcatttctacaggagtaaaccttcgcaaggggattgtatttaattcagggtcatatttgactaattcattgctcataaaataacctccttgaataatactaccttatttgaatacaggagtaaataaatgtagtcgataaacagac

SEQ ID NO: 88 - DNA, 5722 bp, Lactobacillus plantarum
ctcgtatttgagatgacgcgggttatgcgttagctcaaatcgacgtcggctgcgttccagcaattgtcacccagccccggaggtcggaatagaacgctcaccggctgacgaacagtaagccaactaaatggcatgttttaatcatgtttcatgacaagttaacggaagaataggtaggatgatcaagtttgagtaaacaagaggtataggagggaaaaacgtggattatcaaataacgcaggcaaatcagcccttgatgccggcatactttcaggggcgttgggcggtcaagcaaattgcggatcgagacgtgatgtatagcactaatttgggtgctgaaatcgattttcaagtcactgatgctagttttgtgcggttgacattcttgccgttggcgtatgagctaccgagttgggtggcgattcagattgatggcttgccttttcaacggcaggcggtgacgaatgaccccctatggttgacactggatggtcggccccacgtggtacgggtagttttgagtggtaatactgatgaggaccgtgtgtgggatggcaatcaaggttttgcagtgaaagccctgacgacagatggtgagttacagccagttcagttaggccgacacagcgtgacgtggattggggattcactgacggccggctgctgggtcatgggtaagcaacctgccgaagattatcgcgcggaagctaactatgcggcggttgcgagtgacttgttgaatgcacggaatgtccgcattgcttatagtgccgttggtctcagtaaaccaggaactggtggcgtaccggtactgccggaggttttaacagccgtggatagtgaaacgacgtggcaaccagtacccacggatttagttgtgattaatgtcggtactaatgatcggcatacggatgatacgacgttcacggtagttttgcgccgcttccttaatcaggtgcagacgctttacccgaatagccggcttgctgtaatgatcccgtttaatcagaattttgcagcgattattcgtgcggtcgtggccgaatttatgcaattgcaactcattgaaacggctacttggcaactcagtaccacggacggggtgcatttagatttagctggctcccggatggcgggcgaattaacagcacaagcgttgcggacacagtatccagatgtttttaaatcgtgatcaacccatcttataaaaatcccgttttactgtagcaatgttctgctgcagtgaaacgggattttttggtggcactactagatttttaaaataaacgttaacgctggcggtgtagtgattgcgactgtaaataccgggccgcagcgagcacttcttcgggaatatccacatgggcgatgaagccctgaccacggggaccataaccggtgggggtatccactaggcgttgaaattcaccgagtaagagttcagtaaaataagcgggttgccagccagctactattgtgtttggcgtaaagtgcattggttgtagccggtttaattgcaaggtcgccggcgcatagcgaataaagttggcattgggccaattggctgagaacgttagggtagtccgccgcgcgagtaacgggtcttgtacgagtagaacgtggcgccaatcggtgggggctaacgcgcgggcatgcgtggcattgctaccggtattggtagaagtcttgtcgaggcggatactaccttgatagccagtctttcgaacaagcgtcgccatcaactcagcctcactaacttgagattttggcaggtttaagttttgccgcaaatacttagtggcgtggccgataccgcccgcaataatgagtagtggtaattgatagtcttgggctaactggcccgctgcagtggctgttgctgggaggctgttgccacaaaggaccaggccatcgaggtgctcaggcaaggcggtggtgtgtgtcaaccaagccagacattgattgaaagcggtcagttcgtccaattacttggcctccttagtcccaaagtgagccgctgcggccccaaagttgaaccgttggaagtgaacattttgaaagcctgcttgctgaaacatcgttgctaattgttgatagcttgcaaagtgacgagtggtttcctgtaaataagaatattcctgatattgatgggcgaataagcgcccgaatagtgggactacttttgtgaaataccactgccagactggtttaatcaatggttgatcgggttgagacgtctctaagcagaccaagcgagcccccggttttagtacgcgataaatttcagttaaagcttgggctttatcaggcaagttgcggagtccgaagccaatcgtgacgaggtcaaaggtgttgtccttaaacggaagatgcatcgcattgccgcggcgcaaccagacccgatcggcaacctgttgctgggtcactttttgttgtgccagttttaacattggggctgaaaagtctaatccgatgacttcgccgggtgcctgtaattctttagccagcgcgatcgtccaatcacccgtaccacaacagaggtcgagaacatgggcgttaggcgctaaatggatttgtgccatcgtttgcttgcgccaatgacgatgcgttccgagactgatgatgttattcatccgatcatagttcggcgcgatggtgtcgaacaaaccttggacattatgtaaatagcgatttgccataaatgatacctcctgatagttgctttacttactactatagcagatgttagttgccagttaccgtgaaaaggaatgataatcaatataaagctacgatattgatttcgttgctgttaatattgttcgtgaataaaccgttaaactaaagttaaaataacataaaggcagtctcgattggtatttattaagtaccaagcaagactgccttttttgacagcgcgttcctaatcgaagccttaacgtcaaaacgagtacgctagtaatagcttaaaaatcatcatctgcaatttgagctaacaggtcacgtgatggaatgaagaacgcttgtccggatagtaaggtggagaaagttagtaaaaagtcactttggtcgaccatgttttgcagcatgcctttggtaaccgtccagtgacgggcataaccaatgaagtacgtccctgtgttaccagctgctggattggagtacgggacattcatccgaacgattttttgttcgacaccatcaatttccaattttgaagcaacgttgtgagcattcttaaacttgtctgcgtcttctaactcgaagtcgctgaatttttcacggcccacggctttttcctgatcctcggtgtgcatatgttcccacacgggcatatcatgttgccatttctgtgcaaaggcgtaagaaccgttgatgaattggggatcttcgtcaccaactaaggcataatcagcggcatcttctacggccggcgcttccgtaccgtcgataaagccaatgatggcccggccctcgaagtaacgaaagcccttcgtctcatcgaggacggtcgtgattggcgctaaaacccgctggaactgcgtttggcattcgtagacgaccgcttcgttgcttgcgcgaatgtggaagaagaggtcgccgggtgttgctggcatagtgtatttgggtccacttaaggtggtgtaagtttctaattctttaggtttgggtgcgccaggaaacaggtaatcccaagcggcactactgatgccgatgctaacttttaattgggtgccagtttcaggtttggcgtctcggatgcgtaacgagcgaatgatggcttgtgaccgatctgcaaattcttgaaagacttcacggtcgtgttgctgatcctgacgatttaattgaagaacggtaaattgaacgtgttcaccgacatctttccagacatcttgggcgcgatttggattgatttgcatggtatatttcctccataaattgtttgatattgttagcgtacatggtggtacggttagcgtcaaataaaggcaaacggtgggtgtggataatgacgacattcgccagcatcaggggtaggcggccaaactaacgtggtattaaaacatgagtaataatgattatcaaataagcgcaaagctagtttcaaatttgaaactgtattagtgggtcctgtgagctatagctcacaggacccactaataatttaacaaaaatgaaactttatctgtcctaattgcggataattgtaattaaatatctgtgtaattactaagtaacttgtaattcatcgtttttagtaagggatagtttgagacatttagacggctattacaagtatattaataactaaacggattagtcagttggaattgttggtgcttgtaagacattaggaattaattgaataaatagccggtaagtctcaattctgctgagtgttggctgcgtggtcgcaagttgccaagctaactggtgaagacagttgccaagctaactggtgaagacagttgccaagataggttgccataaaatgccgttgcttaggatggatggctaagctagttagcagctgttgggcaaaaccaacttctaatgggatgacccgatcgcgacactgtgcccatgacacgagtaaggggagatccagatgtgcgcgaagcgtcgtgacgattacaccagcaatggttgcgtaagatgtggtcgttaagtcatttaacgcttgtcctaactgttgtaaggcaattaagtattcaatcacgatgatatcttcaatatcctggtgatgacgataaaaagtggcacgtccaacgtgggcatccagacaaagttgtttgacagtcaactcgttgaaggtcttttgagccttgaaattcgcttgcagggcagtaatcaatttacgatgagtttgatgagttcgctgatcaatatgcaattgattgttcataattaattttgtcatatgtcaatgatacaccaacttgtgatatgtctcaaaacgtcccttttttagcatgtgaaagcgtctataatagctgtcacagttagatatagctgaccaattaaggagattgtcgactgatgaaattaattaccgttgaagagcattttgaatcggcagctgtgactgccgcaatgcgtcaagctgttggtaacgctgcgttaccaacagttagtccagcgctacgccagtacatgcgtgacaatttaccgagtcctgcaattatgcaagacacccagcatgaacgactggcatttatggctcagtacgcctgtcgttcatctgaatggtaataaggcatacgtggaactaccaactacgacgcatatgcgcatgatggtcaatggtactttagcggaattagaatcatatcggcgactgatttaccgtgtcgaacgccgtgatactaagtggaagattagtcgattgacctcaattaacgaaagtgataatttacgaccagtcattgcgggacagaatttacacgtgatacctcaagattttaacggtttacggccctcgtatcaattcctggcctatgtccgacaagctgccggtggtcaaattagtcaggacttattagggacggatcgaccagaagaagttgagcgattgtacaaggaaacgagtgcgtggttgcgagctggagtatagttgaaggtaaaataaaaaaagcgatatcatgtaaaatcaaatacttttagcaccttgtaaccagcaataaaaataatttagtacattcggtagattgcaaatttaatc

SEQ ID NO: 89 - DNA, 6912 bp, Lactobacillus plantarum
gtcgctgtccgagtcggaatcactatcagagtcggaatcgctatcggaatccgagtcgctgtctgagtccgaatcactatcagagtctgagtcactatcagagtctgagtcactgtcgctatccgaatcactgtccgaatcggaatcactgtctgagtccgaatcgctgtcgctgtccgaatcactatcggaatccgaatcactatccgagtcggaatctgaatcactatccgaatccgaatcgctgtcggaatctgaatcactgtctgagtcggaatcactgtcgctatctgaatcgctgtcggaatccgaatcactatctgagtccgaatcgctgtctgagtcggaatcactgtctgagtccgagtcactatcagagtctgagtcactgtcgctatccgaatccgaatcgctgtcagaatcggaatcgctgtcgctatctgagtcactgtccgagtctgagtcgctgtcgctatccgaatcactgtccgagtctgaatcactgtcggagtctgagtcactatcggaatctgagtcgctgtccgagtctgagtcgctgtcgctatccgaatcactgtcagaatcggaatcactgtctgagtctgaatcactatccgaatctgagtcactgtcggaatccgagtcgctgtcggagtctgaatcactatccgaatccgagtcgctgtctgagtctgaatcactatccgaatccgagtcgctgtcagaatcggagtcgctatccgaatcactatcggaatcggaatcgctgtcagaatccgaatcactgtccgagtcggaatcgctgtcagaatccgaatcactatccgagtcagaatcactgtcggaatcggagtcactgtcgctatctgaatcactgtctgagtccgagtcactatccgaatcggagtcgctgtcggagtcggaatcgccatccgagtctgaatcgctatcggaatccgagtcgctgtcggagtcggaatcactatccgaatctgagtcgctgtccgagtcggaatcactgtctgagtctgagtcactgtcggagtctgagtcactgtcggagtctgagtcactatcggaatccgaatcactatcggaatctgagtcgctatcggagtcggaatcgctgtcggagtcggagtcactatccgaatctgaatcactatccgagtcggaatcactatccgaatcgctgtcgctatcagagtctgaatcgctatcgctatctgaatcactatccgaatcggaatcactgtccgaatcactatccgaatccgagtcactgtcgctatccgaatcactgtctgagtccgagtcactatcggaatctgaatcgctgtcagaatcggaatcactgtctgagtccgagtcactatccgaatccgagtcgctgtccgagtcagaatcgctgtcggagtcggaatcactatcagagtctgagtcactgtctgaatccgaatccgagtcactgtctgagtcggaatcactatccgaatccgagtcgctgtccgagtcggaatcactgtctgagtccgagtcactgtctgaatccgaatcactatcggaatctgagtcgctatctgagtcggagtcactgtcgctgtcggaatcgctgtcgctatcgctatctgaatcactatccgagtcggagtcactatcagagtcggagtcactgtcgctgtcggaatccgaatcactatccgagtctgaatcactgtcgctatctgaatcgctgtccgagtccgagtcactgtcgctatccgaatcactgtctgagtctgagtcgctgtccgagtccgagtcgctatccgaatccgaatcactgtcagagtctgaatcactgtcggaatctgagtcgctgtcgctatccgaatctgaatcactgtcagaatcagaatcactatcagaatccgagtcgctgtctgagtcagaatcactgtcagaatcagaatcgctgtctgagtcagaatcactgtcagaatcagaatcgctgtcagagtcggaatctgagtcgctgtcgctatccgaatcactgtcgccgtcagaatcactatccgagtcatcttcactaacattagcagctaaatcagcatagtagcctgcatcatcagcggcacttgaagctttctttttagcttcagatgcttcggacgctttctttttagcttcctctgcataactggaagcagccgagttttcgccggcagcttccgcagaatctgcatttgattgggcggctgccgcattagaggctgcagttgaagcagctgttgcagctgactgtgcatcagaagctgctgccgttgcttgttctgcgtaggagcttgcttctgagtttttacttgcatattcgcccgcaatgttcgcataagaactagcaactgaaccatattccgtcgcttgatttgcgtagttagctgcttcgctagctgcagaatctgccgcttcagttgaaacagcattaacagtcaagtaagcccggcctaaagttacagttgtcgtggtagtagtcccgttagtcgtattggatccagtaataactaggtagtaataaccggattgccctactgtcagatccgacagattaagtgtcataccagtctgaccactcagcgctgttccagtaccgtccgctgttgaagaataataccattgataagtaacattagtcccagtacccgtagtcgagccatctggaacccacgtcaaatcacttcctgcatcaacagttgcatcctcaaggccactaccaattgtaattgtctttgaagatgaatagctagttccgtctgcatttgtaattgttgctgtgattgtcaccgttccattagacacaacggtcaaaaggccagaatcatcaattgtcgcaatgcttgaatcacttgtcgtccaggtaatcgttcccgtagcattctcagggttagtcgttgatgtaaactggctagtaaccttatcgtttgagccactcgaactgttcgttggattaatgacgtaatcatcaccagctatggaaatgtttgttgctggaatattgctactataaacatctacttccgctaaattacttgcaaatgtataaactgtagccaagtttaataagtcccaagaaaacccttgtacggcttggaatagtaatgatccagtatagcccgctttgatagtaactgttaatgagctactggttgacagtaaaccagcactgtcaactgcatcatatgattcaatataagcgctggccttatctaaggtcatccaagtgccgttgacttgaacataccaagttgtttttgatgatagtgcaaccccacctagtcctaatgctgacgaagctgacaaggtaaaggtcccaccagaaacggtcgacgtcactgctgcgggttgagaagtcatcccaccagaaataacaatccctagaattgtcgttgcattacccgtattagtgcttttatatgaattcgtattgtttgaataattcgtcgcgttgctagccgccgtactacctaaagccgcattggatgtagacaatgccgcatatgaggttgcttcactagctgctgctgaggcattggtcacatatgagctggccatagcataatcgcccgcagctactgccgatgaatcctggcttgtatactgagctgccatttccgcagctgaagttgcggccgccgctgcacccagagttgtcacggcataattattagtttgtgcaacgtatgagctacccaacgtggtgtttgacgcatactttgcacttaatgaactcgcgacactgattgcgttcccggctgccgattcagctgctgacgctgcgctagaagcagccgttgcaatcgaattataataactggattgtgcttgcacgaccgtttgggtaatcgcactcgccgcactcgaagcagcattcaattgatctgtggcataggttaaacgcaaagccgcgtagctttgttgcaaggcagccgaattataattcccgtccgctgcatatgaagcagcaagacttgctgcttcactagctgccgctgcgtatgaactagccgctacagctgcagaacttgccgctgcattataactgctagttgcagtggtattaaatgaagaaccagcaacgttatatgcattagcagcgttggccgcataggatgcagctaacgaggcttggtcaccggccacatttgccgatgacgcagccatactggcataacttgatgctaaataatcagcagcggtatcaccaccatcttcattaaccgcatttttcaaagcagtatcgagactagctgctgcctcagatgccgcactacttgcagaactagcatattcggttgcaacactcgcataactcgatgccattcctgcccagatattagcactggtatacgccccttcggcttcataagaagcggccgaagtactggccatagttgcaatacttgctgcttccgaagccacactcgcatatgagctagctgcgttgtatgaagaattagcctgtgatgtgtagtaactagctaatgagcccgtcaagttagctgaagaactggccaaactgatcgcactacttgcagcggcggcttgagaggttgccactgaggctgcgctgttggcttggctggcataactgctggcaatttcagtgtaggtcccttctggattagtgacaacaatggtaatcacattaccagctgctttaaaatctgaagtgaagactaatgccgtgactcgcttaccagtcacgactgcttgataataatacgtccctgaagtagttgcagttgttgtatacgttgccgatgttgcaccactaatggtcgtccaagttgtcccatccgttgagacgtaccaaacctaagttggtgtaccacttactgaataccctgagtccaaacccactttgttggtaattgtcacagtatctccagtcgagacactttgcgttgccgtactcgtcgttaaagtcgcattggaactaacagtttgttcattagcgacatccgtcgaaaacttagcagctaaagtcgcgttagactcggcagttgcagcgtaactagcagccaatgaagatgccgattgggccacccgagcgtatgagtccgcggtggcaggatcactagcactgacagcagattttgcagccgtacttgcgacggcgtaggctgatgaagcagagctagcggccgttgcagcacttgaagcataagctgacgcttgagtaccagtttgcgttgctgccacactggccgcacttgaagccgtactctttgctgtattcgccacgtttgcacttgaagaagccgcactcgccaaatcactaattgcagtactattggcaaaactggctgccgaactagcggtgctagtagcggtgctcccggcggcatattgaccaagcgcctccgttgcggcggaggaagtaactgcataggcagtactagtggcttcatagtcattatttgccgcattactacttaccgcggcataggctgaggaagctgccaccgcagcggtcgttgcgttaaccgcggccgttgaagccgcagctgccatgctagaagcaacggtgtaagctgaggtaacggccgtattatttttgtcgtattgcatggctaagtatgcactgttggctgcttcagctgccgagctggctgctaccgtggctgcagatgccgcactagatgcggcggaataattgctacttgctaaattaattaagccttgggtagcagcactgctggccgttgaggtggccgttgaagccagggctgcgtatgaactggccgcactcgctgcactatatgctaaagaatttgcaccagagtatgcgattgcattatcaacattggaccccacaccatttgtcaatgcgtctaagtacatgtttgcaatactattgtagtgccgtgacaaatcagccgcgttaagcgcttcttgataggcactttgggccgcactcactgctgcttgcgtcgttaggttattgaccaaactagcatagctgctggcaagtgtggcgtatgaaccagctaatgaagctgatgatgaagccgccttagctgcggtactatcggtatgtgagctggcagccgataccgacgagtaagctgcaatggctgccgttgaagccgccgtacttgcagacttagtcgtgctggcaacactgcttgctgtcgagacagtacttgccgctacgctagcactgcttgacaaactcgtcgtacttgagctagctgcggaagaactgctgctatcagttaaactcgatgaagtagcgcttgacgagctcgaactactacttgaacttgcgctggatgcgctcgaactagccgttgaaacactgctactactagtacttgatgtacttgtcgcattagtcgtacttgtttcgctcgcagaacttgcgtctgaagcaccgtcatcgctgcttgaactatccgatgaagattcggaattactgttcgaggcagtttcactcgaagaagatgccgtagacgagtcactggtagtactagttgacgtactacttgccgtatcgctactagtatccgccgaaaccgtatttgcatgagatactaactgaggtgcagcagtcaatacaaatgatgccatcgccgtaaatacccaagtacggccgactttaaacatcttgtagtgaactttcggatctcctctaaaagatttatgtctcagaaatttcatggttttgccttccttctctaacctaatcaaacccgtttatatatgatacaaaaaatacatatatagcatcattggtatacaccatcaatcgttaggctatgcactcataatactatgattatgttttgttggcaatagttgataccgtcaatcttgttacacgttttccattaattttcctaaaatagttaccaaatggtagattgcaaattt

SEQ ID NO: 90 - DNA, 5360 bp, Lactobacillus plantarum
gattaaatttgcaatctaccaaaagtacaattattatactaaatccccttgcgagcggggcaatcaaccgcttataattaaactgctttaagtaaattaaaaaagggtgttcacatgaattttaaatcacaaaatccaattgatgcaagtcagtcggaaagattcaagctttataagtcggggaaactttggctggttgctggattaactttcttctcatttttaggaggttccgttcttaacaatacaaacgtgcacgctgatgttacgactgcgacgacaacatcgtcttcagctgcaagcacggcctctagtgcaagtgttgcaacgagctctgctgctagcgatgcgacgactaaagcgacctcagtttcgtcaagtgctgcgactcaggtaacgagtgcggcaacaactaagacgaccagtcaagcagcgacggcatcgtcgagtgcggccactagccaatcgaccagtacagcatctagctcgactagtcaagcaactaagtcggcttcgagtgcagccactagtacttctgcaaaggctacaagccaagcaaccagtgtcacttctagtacggcaaccactactcaagtaagtcgtaccgcaagcagtactgccgccagtgctgcttcaagtaccgcaacggtcaaagctgttacgcccgcttcaagtacggtaagtagcgcggcaacgaccgctactaaagccacagctaaagttgctgccgttgcttataccgcagcaacgacgtcttcaacggatgtctggacgattggggatacgactcggccacgcgttgatgttgttgacgtggcgtcatatcaaagtaccatgacgcaatctgatttcaataagttaaaggctgcgggtgttaagacggtcatcgttaagtcgactgaaggcactgattacacgaacccagctgcactgaaccaagcaaagatggctaataaagctggcttaaacgttgatttctaccactatgcaacgtttagcacggctgatgcggctaaatctgaagcgactaacatggctggtttcttagttaagaacaatgtttcaaccaaagttctcttgttcgctgacatggaagattcatcttcatactcagttaacgcaacggcgaacttgaacgcgttctggtcaacgttagattcctttggttacaagaatcacggcgtttatacgtccaactcatacttatatcgagatgctgttgttaagacagttggccaatcacgtgtatggcgggcccaatacccatacacaccttctgctaataacctttggaacaccaatgatggtgcatggcaattctccgatacggcactcttaccatctggttcagattataccggttacattgatgtcagcatcgattacaatggtttaactgaagatagtgccgggaccaatacattcgtaacgacaactagtagcaatgatacgacgactagtgaagtaacgactgacactagtgccacgactaatacgtcaactagttcaacgactaagaaggcctctggttggtatacctttaccaagaacacagccatcaagagcgctgccagtgatagtgctaaaacagttggaacttatagcaagggtaaccgcgtttactataatgctgaaattacaactaatggtgaaacttggttacgttacttaagttacagtggtagcgaacattttgttaagattgccgcagctaaaacgaccacgactaagccagccgcaagcactagcaagacggttaccaagaatgaaactggcacttacaagtttactaaaacgacagctatcaagggttcagttagtgactcagctaagactttagggacttactacaaaggtgacacggtttattacaatgccaaggttactaagaatggtgaaacttggctccgttacctgagttacagtggtgcgcaacactacgttaagatcagtggtgcagctacgtcaacgactaccaccaagccagccactagttctagcaagacggtcactaaggctgaaactgggacttacaagtttactggcaccacggccatcaagggttcagttaatgattcagccaagactttagggacttactacaagggtgatacggtttattacaacgccaaagtcactaagaacggccaaacttggcttcgttacttgagttacagtggtgcgcaacactacgttaagtttagtggtgcagccacaacaacgacgacgtcaagcaagtcaacggctacggctagtgctaagacagttgcgcaaagcgggacttacaagtttgctaagacgactgccatcaagtcttcagcaagtgatgccgcttcaactgttgggacttactacaaaggcaatacggtcaactacaacgccaaggtaacgactaacggtcaaacttggttacgttacacgagttacagtggtgcgcaacactacgttaaggtcagtggcggtgccgcaacgaccacgtcatcttcagcaagtaagacgacggcggctgctggtacgtacacatttaagaccacaacgaatattcggaccgctgctagtctaaatgcctcagttgttggccaatactccgcgggcgaatccgtttattatattggaacggtttctgcggatggctatcaatggctgaagtacttatctaactctggtgcttaccattacgttgctaagattggctaacaattagttaccaattactagtgcaataacaaaacaggctttgagatcacgtcaagcgacgcgatttcaaagcctgttttgttgtgtgattgagttagtggcctgttcatcttattttgacaaaagtcggcatagacgcacttgacaaaaagtttatactgattcgaacttctttcagtgggcctaagctggtagcttttgacactaaaagtttgaaacatgcttcgtattcaagcacgtgtaatcggtgttgtagtgaggggctaatgtttataaaacaactaagccgccagcaccgttgtcgtagtcaggtttctgagcagtgacaaccagtttttcgttaacaaaggccattaagcccaggctgcttaactcgcgaccgtagccggagcccttgacgccaccaaatggtagttctggtaaggaactgaggaaggtgttaacgaagaccatcccagtttcaatttgttgggcaaccgctttgccatgcgccgcagttccggcgaagacgatgccacctaagcccagttcagagttgttggctaaatcgatagctgcttgttcagaatcaactttgaagacttgggcaactggaccgaacatttcttcgtaaaagagggggttgtcttgatcgatgtccgttaagatggttggttggaagaattggccaggtaagtcgattggttcgttgccataagcaacggttgcaccaccggcaatggcccggtcaacttggtcttgtagcttttccttagcgcgtttggaattcatcggtgccagggtagtttgtgggtccataggatcgccagggactaatttggcaaaacgttccttcaactttgctaagaaatcatcgtacacatccgcagcgacaataaagcgttttgatgaggtgcagacttgcccagcgttgtataaccggacccgccatgctaagttgactgcttcgtcaatatcagcatccgctaagacgacgaaagcgtccgaaccacctaattccatagaactcttcttcaagtttgcaccggccgctttggcaaccgcttgtccaccacgcttagaaccagtcagtgcgacgccctggatgcgggggtcggcaataatatcgctaacttgatcatagtttaagaagaggtttgttagactaccagcgggagcaccagcttcttcgacaatcttggcgaaggccgcagccgatcccggtgtattagaggcgtgctttaaaatcattggattaccgaccatgtagttcggtgcgaagacccgcatgatttggtagtatgggaagttccaaggttcgaccaacatcaggacaccggttgcttgtttttcaatttcggcatcacccgttgcttgagtgctgattggggtcggtgccaataattcagcaccgtgatcagcatagtaatcagcaatcatggcgcatagttcgacttcaccttgagattcactcagtaatttacccatgtcgattgttgcaattttagctaattcatctttatgttcacgtaacagtgcggcaatcttatggaggctggctgcacgggaactaacgggttcatgacgccattggtgataaagggcgtcgccggtagttaaggcctgttcgatttggtcagtggttgcgttgtcgtaagttttgacaacttcattggtatatggattaattgtttgataagccatagtaaactcctcctataaatgttcaggtattgtaaacggttaatctgcgattgtatgggactggtaaccgccttcactattgtacgctaccacaaaagtacggacaaagtcagctaatttgacttgaccagcgctagtgtcagaagcatttaggtctgcataaagtccttcaggttcgcgctgataacgactagtttggactaatgaagcggcaattttaacgggaacaccgtggttcgtcaagttagcttgatattgttcatctgagatttgtacccattgtagatcgggcatgtttaaggcgtcgcgcagatcagcaacgaattggtcaccggtgaacgtatcactgaaggcatactggacggtgataccggctggcgtgtgatcgattaggggataaacgacactggcaatgtcctcgggcgcaacgtatttttgtgctgaagcagcaggcgtgctggaataaattttatgttcagccttgattgttgctaagttaccgaacaagttagcataaaatccagttggacggacaaaagccaggttaaccccgtcaagttgtcgtaattcatgttcaattaagttgtaagcatgtagcgagccagccacttcatcggcatccgcgccgatgctactgaggttgacgacgttggtgacgccggcattttcaattgcctgtttccaaattttagcctgagccacggccccttcgaagggatcatcaccgataccaccagaaagcatgaggtaaaccacatctttgccagaaaaagtggtggataagaaatcaacatcagtcattgtgccaatggcggcatgggcgccgacagcttcaattgaagcttggcgcttaggactagttgagataacggtgacgtcatgaccggcttggacgagcttagggacaacgatccgattgatgtttcctaatgaacctaacattgcaattttcataattatagggtagattgtaaaattaa

SEQ ID NO: 91 - DNA, 5298 bp, Lactobacillus plantarum
tggaagtcggcgtaggacgcgtttaaccaagcatgtttacgctgattcgaactttttccagcgggcctagctggttacttttgatcttaaaccggaaccttttaacaatatttcgtgcagaaaaggcttggtattatgcggatataattttagggcgtcattctgcttggtctgggagttttaaaagcggataatgaagctaattctagggggagtgatgaggatgaagcgacggttaattgcagcgcctacgggtcttttattggtgggatggttgattggctggggcttgcaagcaatacaccaaccgatggggacggcttggacggcctacgcgtttacgttattgatcttatatacaattttggcgacgtttatcactagtatggcggatgcctatcagggaaatcatggtcgaacagtaccggaaaaacaattttactggtatatgtgtacgttatcagtcattttgacaattttagcgatttattggatggcacacaattagggggattaatgctaatgcaagatgaaagtgattggttaatgcggcagttacatgcgttcgcaacggggttagggtacacgcttagtcgtcataagggaggcacaactgaggtggtgtttccgcaagatcaagatcagccgttgccacatcaagtcgaattggcacaactaattgacagaagggcttatgctcaagccgctcagcggttgttagcgttgcagttcgcaatgacggaagctgaattcttgcagctcggaatttggctttatgcgacgcttaatcaatttgacgaccaaagtctcgctgccgggggaatttcacgaacatcgttggtggcgggattggaacaactgcaacaattgaaaatgtgatgctaagatttaagcaaatcacgaatgaatttggcaaaaaagagattcagctatgacggaaaaattaaaagtcgtgctctcagaatttaatcctgaaagcacgactttaatttaacgcgtgttcaattatcggaccacatagacgtggtcgtgaatcaggtcgaatggtcggaaatgagcatttaacttggtaacggcctcgttatcctgataattagcgtggtcccaaaattgtttggaacccgtggcgccgtatttttcgccaatgacgatcaatgggatatcgtaaggactttgccgcatagcttgtaacaagtcccaatcaatagtcaatttgtccggtgaccaggccataatgacgtatttaatagttgcggcgtacttattgaaggcactgacggcatccaacgcttcaatcgtcgtgactgggtggcgtcctgtctgattgccagtttcgtgtgtccaatcctttgaatccgtggtataaattggctgaccaggatggagacgtttgaggcccttggaaatatagccgttaccggccatgacttccagaactggtgcgctgccggtgaagtcagctaggtctttcagaaatggcgcactgatgtaggcccacatcccatactgatcttcgatatagtctcgaaagttgcgtagaagttggtcaacttttgggagagcggctgatagttggttccaagccgcatcaccagcaggatcacccatggcatattgctgattgatgcgctcaaagagatggtcctgaaaatcatcagggatttctaagactggcaattgttggggagctaagccggctgccagcaagcggtcactttccaagacattattgatcagcactagaatttggggatcatccttaaataagtcgcggtacttcattaactgttgaatatacggggcaccggcttgctttttgacccgcttttttaattgttttaacttcttgggattcataaaaaactcctagtcatcaaagtgtaagtctaattcttcttggccggtcgcatccgttgaaactcgatgctggcgaccatgtaagtaaccatccatcaactgaaacagttcatagcggtcttcactggataattgttcttgattaaacgtcaacggcttgcccgataaaaagatgcgaccgaggtcatactcttcttggtctgatttacctgacaagtaatcggtcgtgacgttgaaaaattcggctaatttacgaacttctaggtaggacggggtccgtaagtcccgctcccagttaccgatttgagccgcggtattttgacgagtcgtcttgtctgcggtcggcatttgattgagggccgccgcgagttgagcgagggtcattttttgcccccgacgtagtgctcttaaacgttctggaaacatgtgctcacttccattccttagattaacggtgcggataacgccatgaattcatcgatgtcccgcttgatcaaagctacaccagcttgccagaaggctggtttggtcagatcaacaccgaggtgtttggcagctagggcttcggtcgacatgttggcggtgtctcgcaatagggcaatgtagcggtcttcaaagtccgattgtgttttagcttgagcatagataccgagactgaaaaggtagccaaatgtgtatggaaagttataaaacgggacgtcgtcaatgtaaaagtgcaacttgctagcccaaaacatcgggtggtaagtatttaaggcattaccataggcgtctttttgggcggttagcatcaagtctgacaaagtatcaggagtgacgatcccgtgctgacgggcggcatagaagcgcgtctcaaacaggaagcgggctcgaatatccagaaacatggctaacggattttgcattttagcatccaataaagttaatttggttttggcatcatcggccgctttgacactggcgtcagcgacaatcagttcggcgaatgttgaggcggtttcggccacgttcatcgcgtaatcttgacgccaaagtggcagatcttgaatgacgctgccatgaaaggcgtgccctaattcgtgggcgagggtggctgtgtcattaggtgaacccgtaaacgtcatgaaaattcgggattcgtgggtctctggtagattttccatatagccaccaggccgcttattagggcgattctcagcttcgacccaacgatgttcaagggcgtgttgggctaaagcgcccatctttggactaaattggcgaaagttgttaatgacaaaatcggcagcttgatcgtaagtttggttaggaagttgtcccaaggttagtggggcttcaatatcttgccaatctagttgatctttaccgagtaactgggccttacgcttcaggtaacttagtaaaatgtccttgctgtcagcgacaacttggtacattgtgtctagtgtcgcttgactcatgcggttgagttctagtggtttttgtaggaagttcgtcgtaccatgcgcacgataattggcaagtcggaagcccgccaagtggttcaacgtatcagcaaagggagcggcgtgagtttgccaagcgtgctcccagttgcgcattaattcggcgcgttgagcgttcggcatggcggctgctaacatgttttgagcttgacccgcggatagttgctgggttattccgttttcatcggtatagggcacttgaatttggctaactaacgtgtcgtagtggtcactccaaccctgaaaaccgtcgagtgctaagtcattgattagggcttcagtgtcgtcatctaggagcgctaagccttgctgacgcatttcggttaagttaaaggcgatggcttgtagtgccggttgttgcacgagcgtgtcaaaggtggcttgatctaacttaacgagctgcttcttgaagcgggttaataaattgtttaactgattatcaagttgataaatttggttcaatagtggggcggctttggtgtcgtccgcatgtgcggattgataagcaaccacgaaaacggtagcttggtcaataccggcttgaatggcttgcagactgttgacgagttgggtaaaccagtcggcgtctggtgtgtcagcggcagcacgccagtgaactaaggtgtctgctgtcgtggtcaactgctgtttaatcgtggacatttttgcagttagtgctggggaatcaatgccaccagcaaagatactgtccaaatcccacgtttcggaatagtgcataaaaagaagcctcctcaatctggtctagttatctttaattataacggttattatgaagtagtggcgaaattttcccgctcaaaacagatttttgtctcatcaaggagtgaattttaatgaagaaatggtggatcacactgggggtactcgttgttctggtagcggtagctgtgattggtgctggcagttatttttaccacgtggcaattgcccgtggtgataagtcatttgttacgcagagtacaaagctatcgaaaaaaagttcggtttatcaccaaaagtattggtatttacatgcgcgtaagcaaacttggactattgagtcatcggatcatttacggttggttgcttggtatattccagttaaaaattctaagaggactgttgttttggcacacggatttgctgggaataagggtttgatgggtgcgtgggcggggatgtatcatgaactcggctacaacgtgctggttcctgattcccgagcaagtggtgcgagtcagggaaaagcggtcggctacggctggctggagcgccgcgacgacttgcagtgggccaaaaccatcgtacataaaacggccacaactcaaatcgtgatgagcggtatcagtatgggtgcagccgggatgacgatggccagtggtgaacggcagttgccacagatcaaagcgtacgtcgtcgatagtccgtttacgagtgctgatgcgattattagttatcaagcggggcaactctatcatttacccgcgtttccgttagtcaacgtaaccagtctcattactaaattacgtgctggttatagcttcaaagaggcggatgcaatcgctcagattcgtaaaaaccacttgcctatcattattatcagcggcacccgggatgattttgtcccgactagcatgggcaagacgctgtaccgcaatgctcaccaacccaagtctttatggttggtgaagggagccggccacaccacggccattactcagaattaccaacgttacaagcgtcacgtcgccgcattcttggaacaatacgtgcagtaatgttagcttgcttgaattagcactgatttgtcatgaatcgtgatattaggatgctaactttcaaggacaaaagcagccagctatggaccactggaaaaagtgcgagttagcgtaaccttgcttagttagttcgtcctacgccgacttccaggcatttc

SEQ ID NO: 92 - DNA, 5160 bp, Lactobacillus plantarum
attaaacttgtaatttgccactttaaaactagtttgtactatgtcacagttcgatactgccatagcaagcatcgtagcatttaagcgatcgcttctagttctataaaataattaatttgctaacattagtgccaccgcgacgagctacaattttgacattttttcacagtacttacacgccaagatagtcgcacaacgaaaatgacgaccgtctgtttgcgacatcatttggccttcgtattccactccaaacgccggtcaaacaaaaaaagagtggccggtcattcctggtcactccgttagtgctgacatattcagttaagctgaatagctggactttgatttaattcaaccacacattaatacaaatattgtaagtcactagccggcgttgggtaagccaataccaaccgttgtaaatctggtaaagtcacgtgtttttcaattaacaacgtgaagtagttaatcatctcgtcggcaacatcacttagaagggtagcacccacaacctgcccactcgctttagcaaccactactttagcttgggcttgttgtgcgccaaagcggtaataagtgaaccacttcgtcatatcaagtgtattgacacgatactcatctggatgctcagtcgccacggccgcgctgatcccgacttgcgctaacttgggcgctgcaaaaacctgcgttggcacaacgggatactttatggctgcgccgggatgcgtcaactcaccgaccagataacgcgcttcaaaacctgcaactggcgttaacttcggtaccggtgtatcgctgacatccccaatggcataaatgtgcgggttggccgtctgcaaatgatcgttgacttgaatcccatgccgatcaaaggtaacgcccacgttggctagacctaactggtccgcgttcggaatccgtcccgctgagctgatgaccagatccgttgtcagctcgaaattatcagctgtcaattgtagaccggtcgccgttttagtaattgcttggacatccgtattcaagtcaaacgtgattccatcagccgtcattgcggccatcaaatccttaaccaaatctgcatcaaaagcttttaacgggcggtcattatgatgaatcacgtgcacatcagcgccagcggcattcgcaatcgtcgccaattcaaagcctacgtagccaccacctacaaatgtcacgcgtttaggcatctggtccaaatctaagaagtcagtgctcgtcttaaagtattcgtgcccggtaatcggtagaatcgccggacgctgaccagtggcaatcacgtaatcagtcgcactgactactcgatccccgaccgctaactgattgtcggattgaaagtgtgcttggccatgtaacgtcgcaatatcttgccccgttagtccgttcaacgtcccatcgttgatgccatccgtatagcctcgtttatgcgccatcagtgctggccaatcaattttgggcgcgccaatcaggccctgcccttgtaaatgttgcgccgcttgtcgcgcttcgacggcgcttaacaggattttcttagggtcacaaccgcggttaggacaagtgccgccccacagatccgcttcaacgatcaacactgtcttgccctgggcctttaatccgctagccatggcattgccggctggtccgccaccaatcacaacaacatcgtactgttccgccattcgaaattcctccttaaattcattagcgaccatcaattatcacaacctagtgtaactgattcatccttaattgacgattaagatacttcttcatgttgactcaagtaagccacgattcgttggcgatccaaatagccaacaacccgattttcttccgtgaccgccacataatcgtgatctgtcaatgccgtaaaggcggtgcgtaacgtggcttgaacgtctaacgattgaatccgaccactcgcaacactgggttcttctgtgagataaccctgaataagccctacacgcccaacgtagacatcatagacatttttagctcggctcgcgccaaagaagttccgcacaaagtcgttcactggatgctgagccagagcagccggcgtatcgacttgtattaactgaccgtgttgcatgacaccgatccgatcacccaacttcaacgcctcattcatatcatgcgtcacgaagacgatcgtgttgtgatagcgggcgtgtagccgtaagaccaagtcttgcaattgttgccgcgagatggggtctaacgcactaaatggttcatccatcaaaacaatatctggttgcgccgcaatcgcccgtaagataccgatgcgttgctgctcaccaccggataattctgacggcatccggtcacggtattcctttggatcgaggccaacttccgccaatagctcatcaatcgtttgattaatttccttcttagctgtccctttcatttctggaatcacggcgatattttgcgccaccgtcatcgttgggaacaaggcaatttgctgtaagacataccccatttgccaccgtagacttcggactggtatcgtggttgtatcagtaccattaactaggattttaccagccgtcagtggctctaagcagttgatcattttaagtgacgtcgttttgccactcccagaagtccctaccaaaacaaatagctcaccctggtcaatcgttaaattaaggtcgggaatcacggtctgcccattaaagtctttctggacgtgttgaaattcaattgccgttgtcatttaacgtccctccttcaataagccgtgcttcacaagatagcgatgtgcaaccgtcgaagcggactgcttcttaacattgacttcatagttcatttcttgcatatcagtttctgaaatctttcctgctaacttattcaacgctttaacgaccttaggatgtttgttggcaaagttcgtcttcatcaacggtgccccttgatacgttgggaagaagtgcttgttatccttcaataaggccaagtgatactgccgtaattcactatccgtcgcataggcatctaccaagttgattttccccttactgatggcttcatagcgtagcgccggctccatcgacttggcagtcacgtctaacccataagtcttcttgattccttttaagccatcattacgatcaataaactctagggtcattccgggtttcagaatcgattcaacttgcgttaagtcgctgattgtcttcaaatgatgttcttgttgaaatttcttagtcactgccaatgcgtacgtattgttatactgcatcggcttcaagtaagtcatttgttcctgtttagcgaggcgctgtttggcgagctgataggtctgattagctgtttgaccagctgggttatttcccttaactaaggtctccagcaccgagccagtaaattcaggataaatatcaacctgattattctttaacgcgctgaataagaacgtggtcttgccaaagttaggcttgagcgtcacatgaacatgctcatcttcagcttcaatcagctgcttatacatattaatcaagatttctggttcggaaccgagtttacctgcaatcgtaattgtttcaactcgattggcataaacactataagccccgccaccacctagtaaagctaaaataccgacaaagacgattaaggcgtggcgtggtttagccgtttgaaaccaccgaacgagcgcactcagcagaattgctaacaatgctgatgagatagccccaatcaataataacgaggtatcattacggtcaataccgagcatgataaaggtcccgagacccccagcaccaatcaaagcggccaaagtagccgtcccaataattaagacgagcgcggtccgaatcccagcaatgatctgtggtagggcaatgggtagttcaactttaaacaacttacgcattcgtgacatcccaaaggcatcggcggcctcttcaattgaggcgtcaatttctgagatacccaaataagtattttgaaaaattggcagtaaagcatagatcaccagcgcaattactgctggcaccgttccaatcccaactaacggaatcaataaccctaacagtgccaaagacggaatcgtctgtaagacactcgtgagctgtaacaatccctcggcccaccgtggtcgtcgaacgacccaaatagccaacggaatcgcaattaccattgcgatgactaatgatgctaatgaaatccccaagtgttgccatagcgcagtcagcaaatccccgcgtcgatccataaacgtctgtattaatgtctgcatgctaacctccagtgctcacctttattacttaataacttcttaattatccatgtatttaatcgtagcataatccgccaaaaatcatagtaatacgcactgacaattcactaaattttgtaactattgtagtttcatgttaaagttattcattaatttaaaatgaagctggctagtttttacgaaactattagatgaaccactcaatggattatcattacaactaaggaggccccaacaatggctacgattcatctttaccttgcaagtaccaaccaccaatcgaccaacatcaccgcaacaacccccgctgcctgggtcgtcattctgcgatacgctgaccatcaaaaggcgctaaacgacggtggctacggacataccgaaacttcactggccttgagtgctctgaccaccgcactcgccacgttgaaacgtcatgatttacccgttcatgttcacaccacaactgaacaagtggcggcggttattagcgaacaacgttatttaagctggcggcaaaacaactgggacgttcccgaagccgaccagccagacctaccccaatggcaaacgctgattcccattatcgaagaatttcccaacctcaccatcacctaccaccccgtggacgatcccgcgatgaccaccgcaacgactacgctaacggcggtgatgacgaagctataatggcggtgcaaacctaagtccaaagcagccagcttaggcccgctggaaaagttcgggttagcgtaaacatgtttggttagttcgtcctacaccgacttccaggcatttctgccaattgccggaacgtggtgggcacagatttaagccgaaacaccacgtctcaaatactggcctttcactaaccaagcacaagacgcttgctaagtgaa

SEQ ID NO: 93 - DNA, 5013 bp, Lactobacillus plantarum
ttaaatttgcaatctaccattacgaaaataaattacgcattcttttgataaattgtttccagggccgcaatatcagcacttgacaacgtgctcttaccttgtgaaaccgggtacatcacggattcagtcgatgaactgtgatccaaccctaacgcatgacctaactcatgaactgcgaccgatttactgaaagctgaggcgtatgagccgttaagactagccgtcgcgttattccaatattggatacctcgccagctaatttgcttagtaatatcagggccaccatgaccaagttcaacactggtcgtaccagtcgtcatttttttatgatacatcgaaaaagtcactgaattttgtgacccgctggcttgaccagctaccagatggaccaacccagtctggttataagtcgcgacagcttcaagaaagacctgccgggccgctttgggaacattatgatcgaaggaataataatacgtcttctttaaggtggcgttctgcacgatcgattcaatcggtgttgcttgcgttgttgaactagttgcttgcgaactcgagctagtgaccgaactggcactcgcagtcttatccgtctgctgacctgatgattgcttacttgagttagtcgccgaatcttcggtagcactgctagtatcatcagcacccaacaaatgactagataagtcacccgacaaggcagccgctagattctgacgactcgtctgatataaagctgccgcgcgcggggcaagcgtatcatagttgcgccacccaaataacacgaggccgattagacacagcgctttgattccgcgcattagattttttagcatgctgtgcgctcctcttaattttttaacatggtgacaagcaataatttaagtttattaaaccacatgacaccccacttaaacatagctcttagtgaatcattaagaatatttaggattaccgcaatctacttgtaatcttaatccgctttcacacacctactcgtcattctaacaaccgcggcaccccactgaacaaaaaaagacgtgaattttcattcccgtcttgatgtggctacttatttcgaaaaacatacagtttcgagaacaagaagttcccaatgatggcgccggcctgcccaagaatcttggctagtaccgccgagctccccaatactgacatcaacaaccataaaataatcgcttcaacgacgtacgtcacgatccgggtcgcatagaacttacccatttcacgataaacgtggtgtgaatgatggtcgaacactttcaagcggtccacccagaacgcgacttgaacggcaatgacccaggaaataacattagcgacctggtattcgagtccgattaggtggtacatcgtatagaaagttgcaaagttgaccgcaacactgatcaatccccacaagatatagcgaatcgcctgattacgggtttctttaacgggtgaaataatttttttatctaattctgctgctggctctaaaatttcagtaaccgtttcctcattttgatcaactttaatcgaatctggcttactcatggttactacacctgactttcttcacttaaacatgattattgtgaaagaattctgtttaagttgtatcttcatttttatgagtaaaaataacacaacttaatcttagcacagcagttaactattggcgatggcaactattcagttttaccccaataattcacatacacaaaacgccaaccagctttaactgtccgcatcagctaattctgcagctagttggcatcatcatggggccgttgcacatcaacgaataaccaaaatctgcgacaatcatgaattaaaaacggcttgccgtagccgataactcatcattatcataggtgccaaaatgaccgttgagcgtgactcgatcgctactaaatagtggtcgcagcacttaataacaccatccacaacctgaacacctaatctgaagtctttctcgcccgattgagcggaatttcaatcgccatcacggccgccgctgtccaaataaagagatgcaagaagtcaccaactaattttccgctcacattccccgctaaatatgcaccagcatgttgatttaagaactgggttgatgggatctgactagctagttgtggccacaccaacgcgatatttaaaaccgccaacatcgtaataacccccactaattgccacgcctggcgtttagtggttgcccaatcatcaaaataattataattcataatcaacgtcgtggtcatcacaatcaatccaccattaatgaccatcgtcacgatgccgtcgttccaatgcaaaaaatagtgcaaatagcttaaaaatagtaggccaacgactaagtcataactgattgccaccaagcgctgttgccgccgattatttgccgactgagcctcgtagtgttttaacatccctaaatctcccttcaatagttgatcgactgaaaaatcatacgccgtactaatttgcaccaacatgccaatatctggatagcttcgaccattctcccagcttgaaatcgtctgtcgtgaaacgtgcaattgcgtcgcgatgtcagtttgagtcatcttcttttgttgccgaataatttttaaattatctgaaaaattcattttcacacctccaagcacatcgtacgcgacgggtgattgttcggcaagataagtttctaagcaagtcgatgaagccggcgatttgcgcgtgttgtattttttgagaatcgcgaaccaaaacgctacgacaatgatttccgtcatagcgttttagtctgcttggttgactgcttagtaagttaaaaatattattatcaattagaatgttttatatcaaactgttttaattattttgtaggcatacctaaaaaagtatttccatttacttttatttattgtacaatgacaacggctcaaagatttagagatatagaaaggtggtcttttaattgagcgaaaagacgaacaccccaaaccggaagcataaattgattgaatatgctaacggcccttcaccgctaccgctatttatgttgacagcccgcatgcgcggcgtgtctatcagctagacttagctgacgacacggtcgagatctttcaggccgatccaggctcagaactgtctgaacatttcttaccatataagacagttacactgaccacaactcaaatcaatcaattcaagcatacccagccagttgcatcataacggctacgggcaaagcggcgggcacaccctcttagtcaatgattaagaaggcgggcccgccgcttataatttcaattattaatgatccaaatcaactgctcgttgacgatcatggtggatcaaccacaacaatcccaataagagcaccaagagtccaaccaacatcaacgcattcttgaagtgcgctttaatcagttcatcgccaccccaagcatagataatcgccgtgggcatgctgcccagtagcgttgctgcggctagctgccggggtgtcaccgccgtttcaatggccgctaaactaactaatgacgttggaataaacggtatcgtatacccaatcacgattcctaataaggggtgccgcatcttaccaatggccgtcacgagttttgacggctgttgatcacgtcgagccgttacccgtccgaaaaagcgttgtgcaatcaagttgcccagcgtaatgccaataatatttaacactgccccaagccctttgccgaaacagatgccagcaacgacactgatcgtcgccacgggggcacctggaataattgaaaagcaaatcaataagggaactactaataaaatatcaatcgcgcggtgccgtcgaacttgggccaccagtgctgattgatcaaatacccgatgctgaatgatctcccaagtaccatgatagcgatagatcaacagtccaattaatagtaatgctagcagtactgccccactgataagctgtcgtttcgttatcttaaccttcacaacttcctcccgtcattaatcatgatgcggttcatgtttaatttcatgagccacatgtccaatcatggcatcaaccatttccaaaatatggggatcgtctagacaatagtagacatgcttcccccgcttcgttttagataccaactgatactgaaacaaaattgctaactgatgcgagactaatggctgcgccaaatgaacatgttcaacgatttgcgtgacgtccgcttcatggtgttctaaaaaaattaggattttaatccgattaacattactcaatactttgtatattttagccgcctcagttaatagtggcccgctgacctccatgccaattcctccgttctcaccaatcataggaatgcgattaaatggctaattagcccactatcccagaaaacatataagccaatcaccacgtaacaaattttcatcaaccgttcaccatgagccgctatttgcttttgaacagccttgatttccgccacctggttaatgataagcacgacaagcatcgtcaatataccaataaatcctaaagtcatcacaaagtgtaccatgctttccccaacgagcacaggtaaaaagatcgataaattacaaccagcacatacggccaaataagtaactagtacgttaatcaccggcgacccaccagcccgatcggcggtatcatcatcatcgtcgtgaaacgcaagccaaatcggcagcacacccaagaatcctaataaccattctggcaaaaataaggtcagtgctttacccacaaagaagcttgccgttagtagaataagattgcccaacaaatagcccaacaagacctgccacaaccgatacttcttcaataaaaaaactaacatcaagaaaaaatccaaattgacactcaaaaacgttaacgctaaaaccccataatgcatcatttcacccacttttctttacgcgttgtgctagtatttagcatcaactgtgattaaaacgtgccaagtttagattgttgttcgtcagccggtgcgcgtcctaagccggaagcaacccact

SEQ ID NO: 94 - DNA, 4878 bp, Lactobacillus plantarum
cttcagctttaacattcatttctaaaaattaatttgatttcaaaagaacgctccggcaggttatttgccagagcgttcttttagattaacgatgattaagttttaatatgtttaatggctgagcttagtccgtaagcagtaaataaccgaccgtatttcctgtggccgccatatggattatgattacctcatcaaataaattggtgaagtgtttttgatggatgaacaaccagaaatcgtgcaagtgaaagtcggtcggacaacagaagccccagcttctggacccgtcaaagcgctacaaatcaaagttgatggcaataaatcagttattgtttacaaccatgtcaacgggtatatcctcgatgccgtcatgaaggcggtgttcccacatgatcattgataccagcaaaatcgaacaaatctacctagtttgtggtaagactgatttgcgaaaaggtatcgatggactcgcgggtatcgtccaggagcagtacgatttggatccatactcgcaagcactgtatctcttttgtggtacacgcaaagaccgcttcaaagccctctattgggatggcgacggcttcttactattatataaacggttagaaaatggccatctacaatggccgaccaatcaacttgcaattcgcagattggacccgcgtcagcttgttcgcttattgagtggttgggcgttagattcgacagttcataaagtctgccctccaggacattgaaagtgctttctagtttggaaaatgagtggtaaactcaatgataataatcttacatcaaggaggtgacacccatggcagaatcagaaaaggatcaaatcattcgcaagctcaaagcagaaaataaggggcttcaggaacagattgcctatcttaggcgaaaactatttgatcataaatccgaagtattaaatcctaatcaaacgtcactatttgagaaagaaaatagtgtttttaacgaaccagagcaaactggagaccaaagcagctccgcgtcaaatcaagtacggccaaagaaatcaaagaaaaagacgcggcgagaaaaagtagattcaaaggtcccagtacgcgtaaccatcattaaaacagctgatggtaaatgtccagcaggacattcaggcatcaagccgattgggacaagatacgtccgagaagaatttcatttcattcctgcccgtgcatatctggagaaaatctacgagcaaacttataagtgtgaacaatgtgctcatgatacggcaacatctggtttgttcaagccattggtgccaccggccttgttcccacatagtttggcttcggtctccctagtggcagaaattatacatgataaatttgtcttgggggtaccgctatatcggcaactatctgggattcgtcgtttaggttatcagacatcagaagctaccttggctaattgggttaacaaatctgctcaacagctattacccctctatgaggaaattcattggcacttgtgctcggctcatcacctgcaaggtgatgaaactccaatcgaagttctgagagaacctggtaaagccgcgacatcaaggtcttacatgtgggtggcgcgaacaccaatcaaacaaccaaatcccattgtctattatgcttatggtaccacacgttctggtgtctttgcccaatccttgtatgaaggatatctaggcgttttacaatgtgatgggtatagtggggtacaacctacttggaaatagcgttcaccgcacaggttgttgggctcatgttcggcgtaagttctatgatgcatctcagtcacatatcaagggagctgacaatctgcttcacttgattgacgagatgttcgccctagaacgggaatggcaagcctattcaccacgagtacgtcgtcggcgacgtcgtagtcgcttgagaaaagttctcaaacgcttttggcgtctgattgatcgtaccgaggtcttaccacagtctcgtctaggcaaggccatcgtctatgctcaaaagcagcggccgtatctcgaccggattatcaatgatggtgccattgattggagcaataatgcggctgagcgtaacatgaagagtctggtgattgggcgaaaaaactggttgttcagcacaagtacgcaaggcgctgaagcaaccgctatttggatgacgtttattgaaagcgccaaggccaatcatatagatccgcgtcaatatttgacggatttattaaaagcttcaacgattctgccagcatttccaaaatcggaagagttggaggcttatttgccatggaattatcgaagacagcaaaatatgggccaacggaaagacaataatgaggcccaggcgacgacgttcgccgcataaactgaaaaaggaaaagagtgttctaaacttctcaaaaaccgagaagtttagaacactctttttgtattggaaataatctgtaaaacataaatcaacacggtctgttatttactgcttacgttaatcacattgcgtaacaattttaacggtgatttcttgattgtttcctcgattaactagtcggctttgtgtttctagggcgttagcttttcacaaccggggtcttaaaaagatcattcaaggcttcagacattgttggatgagtatagatcatgtcgcgtaatctttcgtaaggtaatttggccttcattgccaatgcaattagattgatggcttcatgagcctcagcggcatacaatgttgcccctaaaataaggtgtgttttttgatcaacgattaccttataaagcccgcgttgatcctccaagacacgggcctttggaatcgccttgactgatagcttgaaggtttgtaaatcataacctgcactcttagcttgacgttcatttaagccgacgctagccagtggtggatttaggaacgaagcagtcggtatcaccattcgatcggccgttgagcgatcccccttatcaaacaattgatctacaataatacgaaaatcatccaatgagacataagtgaacataggaccgccattaacgtcgcccaaagcccaaacgttttgtactgtggtccttaaatgatcatcgacctgaatagcaccacgactggttaaagcaatatcggtattttctagccctaaactatttatattaggccgtcgaccgactgcaactaataccgcatcaaattccgcagtgttggtttgatcaccttgttgataatataatgtaaccttctcaccattatcttttacttgagttagttgagtcgccggtttaatctcgatccctgcgtcagtcagatctgctacgacctcggtcgcaatatcaggatcttcgcgctctaacaatctggtatgttggtcgaaaatcgttacatgcgtaccaaaggaattaaacattccagcaaattcaaggccaatataaccgccaccaataattgctagtcgtttcggttgtttctccaattccatagcttctttagacgtaaaaatccgctgactaaattctaaccctgggattgatggccaatttggaactgctccagtattaataaagatacgttcacctctcaccttcttagtcgttccatcactcattacgactgccaaaacataattgtcgataaaacgggctgacccatcccaaaccgttgctagtggctcatcagccaccatgtgatagtttttgtttcgcaactgtctagtcatctcaccacgcttattaactgctgtagtgaagtccacgccacgttggccattaagaattaaatttttagatggtaggcagccaacattgatgcaagttcctccgtacatttgtttagaccgttcaatcagaagcacggtctcatcatgctgcgccaagtacttagctaatgtcttacccgccttaccaaatccaataataatatttttaaatttatccattgttttacccgccttttactagtcatttgttattgcacttattataagtaagtaaagcgtcaaaagcaatttatatgctcaactacctatttatctgacttgactttatagtcatcatttcaccatcttatttgtcttttaccacagttttccctctagtagctgattttatgaccttctttacttttataatcgtactgtctggtagggtttgcgccccctcttggaccgccctactggacgcttgttatttcccattgcagcagtattattagccttgcttgctgaccttgctagtgttgtagctttcctttgctgtcaagagcagttttattgctcttggttgatttttaatttccctgtataatggattgagcaaaaagttttaagggcggtggctgtcttttcccttgtgaggtgaggcccatgggaacatggaataatcttcaggaaggtttcacagtcaatgagcgtcttccagacactctcgttgatgttgctgtttggcacgtttttaatcgcgctactcagttatatcgacaagcaccacaaataaaaaagccgcaccgatcataactttggcgagttacgggacgacattatcgtttagttaactaatgccaccgcctttgaagcggcttgcgcgggaagtcctgttttcggcgggacttcctttttctgtttatattatagcatgacctttaaaaactggctaacgctttaaactttgatcaaattcggatttgggttgtttgattgatgaattttcttcagtaaatgcttgcagctgtttttgtgttcgattactgatttcatggtgtatatcatttagtttattttttagttctgatttttgttgtgggttccttgcttgctgaacttgttgttgcaagctttgatatgactgattaagcgctcgggctgatagcttttttattttacatttaaattacaagtgcatgcccccat

SEQ ID NO: 95 - DNA, 4858 bp, Lactobacillus plantarum
attaattttacaatctaccccatggccaaatttctgtaaaatgatgtttgcgaaaacaatcatgaaaggaatttagccatggttcaaataagttattaatcacgattaatgatttatttgagctgtggaaggtaaacgcggttctgaatgtctcttaaaacctgtctcaaatattgacttcaatccaaaatcattaatcggatagttaaaaaacagcccaaaaccgccagtgttgatcgcaaggaagtcctgctttcagaaatcaaagatctactcgaaaatcagcaaaaatgaaaacagccggcttgctcaaattgctttcaaacccccaattaattgcgattaccggatatttgacctagaattaacttatagatgattttcacaaatggaaatacttgagaagaggttttgttatgagaacgtttgcgataagggctcgtgatggggttatggaaatcaattattcagagaattccaataagcccccttttaggaagtttatgatcacctacaaccccaaattttcaattggcgataatcttgagaacattaaggctgccctcactgggttgccaattgatgcagcaattattgagaattcattgaactatgaattctctgacacgatcatcggtattaatcatcaaaagatcgatattggcctagcaatggccaacatgatgaatattccggtcgttaacctgcataaggttcaagatgttggtttggaaaaagcagtggcagaaaaacaggaatatttgaagtggcaccttgattattatggtgagtacagcggcaagcgtaactatgggcaagaggccatgctgacaatcggtaacggctactttggcctgcggggtgcgtatgtcgaagcgaacgccaaccaggataattaccctgggatgtacgttgctggtgtctacaatcaactcacaaccaaaattaacggtcggaatgttgtcaacgaagatctagtaaacctccccaatgctcaatacatcagttttggggtggatcatcaacaaccgtttgaaattaaaaaagaagatattcaagatatttatcgaagcctaaatttgcgaaccggtgttttaacaaccaccttgcatattcaattatcaactggccacattttgcaagttcgggctaccaaagttgccaatatgacaaattggcatcgttattccatcaagtatgaattaaaaccaatcaacttttctgggagcattcaactctattcaaaaattgacgggactgttattaatggcaatgttgagcgctatcaggatttcgatcaacaccatatcgacgtcattggcatggctacccacgataaccagatttcgttaaccggtcaaaccaagacgtcccacgttaactttgtgattaattctaagctttctagcaaagatatcgataccaccaagttaattttagctgaaactgaagataaacaaatccagcaaaaattggatatccaagtagaacctgagaaaccgtatgtatttgaaaaatgtgtcacagtatttaccagccaaactcagaatgccaacttggaacaacccgcccaaaaggaactgaacgcttcttcgttcaatgacaccctcgccgacagtcaaaagttctggagcaacgtttggcagaattcagatatccaaattgataatgatatgaccagccaaaaattgacgcgggttaacatctaccatatgcttgtgacaagtgccgccttggcttctggtcaattagattcctcagtcggcgctcgtggcttgcacggtgaagcttatcgaggccacatcttctgggatgtcacctttgatctaccgttttatgctattcattacccagcaattgctaaacagtgcttgttatatcgctataatcgaatcggtgaagcgcgcaaatacgccgcctcggaagacaagcaaggggcaatgtatccttggcagtcagggatgtatggggatgaacaatctcaatttgttcacttgaacccggttagtggtgaatgggatccggataacagtcgcttgcaacgtcacgtttcactgtcagttgcctacgatgtcattaattatgttcatctaacaggtgatactgaattcatgaagaactacggattagaaatgttattgtcaatttgcaagttctgggtcagcatggcaagctacgataaaaaagatgatcgttacgatattcatcacgtcatgggaccagatgaattccacgaagaatatccaaactctgatgatcacggactcactaataatgcttataccaatatcatggtttcttggttatttgataaagtcgcagagctgatgagtcatgaagatcctaagataatcaaatctgccaatgaaaaagcccaaacagacaatagtttacttgatcaaatgagtgatattgcccacaaacttcgtctcgatatcaacgaagaaggcatcattggtcaattttccggttacttcaatctttccaagctcaactttgattcttaccggaagaaatacggtgatatatcgcgaattgatcgactgttaaagggtgaaggtaagtcacctgattcctatcaagttgccaaacaagccgacactttgatggcttattacgaattaccatttgatgaagttcaaaacgtcattacccggcttggttacaagttgcccgccaactactttaccaccaatttaagattttaccttgatcgaacgactcacggatccaccctttcacgaattgtttattcagttctggatgaaatggatggcaatatggatcaatcctggcaattgttctcaaccgccttgttctccgattactatgatatccaaggtgggaccactgctgaaggtattcaccttggcgtcatgggtgctacgcttgaaattgaaaccaagtgttacggcggggttcggtttgacaccgacgaggtttccatcaacccgcaccttccaaccacttggagtaagctatcatttaagcaaacgtatcaaggcatcacgtacaattttgaaatcggtcatcataaaatcaatgtgactgccgattcgagcagtcacatcaaggttggtgacaagggttattcattatccaagaacaagccaactgttattacttacaattaagattaggagtgaaatacaatggcaaagttttcagatattaaaggttttgtcttcgatctcgacggtgtaattacggatacttcggttttccacagccaagcttggcatcaagttgctgacaaggtgggtgccccatggtccaaagaacttgaagacggattaaagggaatcagccggatggattctcttgaaatgattttaaaagcaggtaatctacaagaccactatactgacgatcagaaggttgatcttgcaacggaaaaaaatacaaactacttgaagttggttgacaaaatgactccagctaatattcttccggggattaaagaattcctggatgaaattaaagatggtggttatctgttatcattagcttctgcatcaaaaaatgctcctactgttttgaagaagctacaattgactgattattttccaaagattgtggatccaaaaactttgagcaaaggcaaaccagatccagaaatttacctcaaaggtgccgaactgatcaatttgaaaccagaacaatgcattggagtcgaagatgctgccgctggagttgaatcaattaacgccgctggggaaacctccattggaattggtgacaagacaattttgaaggatgcagatgtgaactttactgataccagtgaaatgaccttggctaacattaaaaaacagatggactaattcaatccatttggaaaactgggacaattgatgctttaatcccatcatttaagggcttcatcccaaaatccaaaacgaggatttcagggtgaagcccttaaatgattgcatgtcgtaagttatttgattaacccgtaatgcttcagcccattcacaattccgccattcacatttgaagtagtgacgaatgatgctttggctttcacatctgggtgaccattacccattgcgactgggtaatccacttcagcaaacatttgcaaatcattcagctgatctccgaaagcataggacggaatgtcccctaattgcgctttcttcaagagtgcttgaatgccggtttgcttcgataccccccacttcatcgtatctaaacagcgaggattatttctaaccaatgacaattcacccttgaattcatcctgatacagtttatctttatcataattaaaaacgttcaagaaattgacttcatgagtcttgtaagagtccggctcaacgtgcggcgtcaatcttaacagccgatagttaactttagttaagtcattttcagctgttaaggcaaattcttcattgttatagaatgaaatcacatcgccctgctttttggcaaatgctaaaatctcttcaatcacctcatcactaatttgctcagcctttagctttttcccttgatattgaacgtaactaccgttcgcactgactaatgaattgataccggtagcgtcaatcacatattgaatttcaaaaatatttcggccagttgaaattacagggagaatattgttctctcgtaactgattaattgctgcaatgttgtcatcagaaacattcttttgattatcaaatagtgtgccatctagatcaaaaaaaacaaccgctttatacattgaatttcctccatttaactcgatatctacattgtactacttaatctactgctccctgaaaatttcgcctgacttttgacaaaaatatgtatattgtgtttccataatttgtgatacactatattgctcctatcctagtatttg

SEQ ID NO: 96 - DNA, 4707 bp, Lactobacillus plantarum
gttttcagacagtccctagtcaaaggaaaatcaaaatctgagtgcgcataacaagcggctggcgcgaacggaccattttgttcaataaacggttctaaccaacgatagaatgtcatcaaatcatcctttcaatactttagttaaattcaataaaactagtttaactgcaaaaaggcgcgttgtataggcgttttaaggtttcttaattaactagcaaattccacataatgcttgtgacgtgtttgtaaagtgatgtaaagatcgtgcaacaacgtaaagttactttaactaaaaaagctaactgtagcagttagcccatcagtgtcacttagtcggttttagtggcttttaaagttcgcaaatcacgttgtcgtagcaagttttggtaatattcgaggctggtttcatctaaccgtagttgttgcatgatctcagtcggttcggtcgtccggtgttgattgagaaaccacagcatgaagtcctggcgcaatgcaaccggctttaatggcacacctaaacgttgactatcacccgccaagtatttatgcaatgccgcgagggtgagatgtgggtcggttccgcgttgacgctgctttaaaaaaaggtccgaactaccactttgagtctgtaatggctgcaaataggcccgtagtttaaccagaaaagcctgttctactgctgtaaaggtaattgcattcaactgctgataaaaccctggggttagcatctccgtggcagtataacccttggtcgttagtaacaagaataagcgggtgtatggatgcagatcatccattgctaaccatgccgctaattgctctggccaggtcgttgtttgttgacgattggtcaagggttgccctttaattgtaaaggttggtaaagttgtaataattcggtgtgaaaataaatagctaaagtagccgtttagattcgacagacatttgttcagtgtcgatgttttgaattggcgttgttcacggagcattgccaagtaagcttgaatatcattctcagttaaatctgctagtaattgatccttagcaaaggtctcattgaaatgctgctcatagttgaaaaagtcagccaaggttaattcatattgctcaatcgtactagcttgcttgccagcagtttctaatgaggcgagaaagcttttagcatacggaaatttagcggtcattgatagtaggacatcctttctgggttagaattcttactttaactaaaacataaatttacaacaaaaacaagcgatttgaccgatgctgagagacgcgttctaagcgcgtgttcgtttattagttgaagaagttgtcccttaaataaaccgtaaaatcgatgttagttatcagcaaatcatgagcgtgcatgcaaactagtgataattggatttaggagtctgaaaacatttgaacttttagtgattcagataagttgatccgaattaacgaaaaatgctcggttgaaattcaatcgactaattttagtgttgatgtttgtgaatcataaaaaataatttaagttaagcggacgtcttgaaaaattctgaacagttagagccagcaaaatgattgcgacaaaatgacaatctgagaactgaatcaccagaaagctaacttaaaatcaaaaaattaccacaggggacctaaatcaggtcgtgggggagcaattttgtttttaattctactttgtataatatatattatgtaaactagaaaatgtaaaaaaagccccctagctagatttacccataatccacacataagccatcataatcacaacaaaccgcttttatcgcgtgaattgtcatcaagtttactgctagcacagcgataatttttgagtggcaaattaatttatggcacatttttataaaatctactgaactcactgaatcatattgatgtgacttaccgtgaatatatgattatgattcataaggtggccaccatgcatcatgaaatagcttttgactgtgttaatgatgttattgctcataactgttagtcaatcgactgaattgctgtgcaccttgggtttaaaactggcttttagaacgtaattgtttatcaagccgatttattgaatcgatggtttgctaacgacagccttattttttcaaaagacatgatttgccatggaccggaaacgccaaaaaccgtatcatgacagtgttcaatcacgcgcttaactgaatcatcagccacgttcaaaaatgttaaagatgtgtaatttagaccagtctgtaatactaatttatctggtcggcaaccacatcagtctaccgtaatttatattagaggccgcttgctaaacaccataaatgtgagtggcatccttgagtactgcggttgtatgaagccccggtaattaacggcaactagcctagctttcaactgtttttgggcgattattagtcagaattgtggcttgacaacttgttaatttcagaccattagtcctaaaattaagcgtatttattgaagctgattgtgccagtcaatttagtgtcaacaattattgcagactacgaacaataattcgccatggcctcatatgtttgttggacatgtgctagatcaaaagtttggtgaataatttaccggggtgatgggttctttcaataccacggctaataaaattgtgtaatttgcagcaagttgtcacgaacgcaatgtcatcacgcaaaccgatattacgcccaaatgggtcgttggggttcatttcaaccttttgtgacaacccctacccggcccaaaatagcacccggtcgccctactcttaagcctattccatttcaacgcattctaaaaccgcttcaacaccagttttatcggatcaattgggcaattcaatggttttgacgacaatatccattgcaacacacgttttggctgaagcctggcggattgacatgacggctcatagcaatgattttgctagcccgcgtaattacgccgaaccaccccccgcactaacagcgtcatccatcgcccatagtactgactgtcgccctgcttaagttgcacggtcgccctagcttgaaacccgttgccatgacatgttggcgaagagcaatcaatcatttagtggtcatcaccgggctgtcctggcaccttgacgagcgcccaatcggcattagtaaatggggattacgggccattaaagtcaattgatccgtggtatttgctaacgatactggcagtgccagctattaactatgaccgtagccacaataatttgatggtacaaattagacgatctgtccccttttaaacattataaaaagattattactgaagtaacagtcactactgtcagtaataatcttttttatatcatcagtttaattttcattcagtgagcttcgaacgctaacgattcatttgggtattgatcttgaaatggccactgccactcaactctgcttgatttgacgccgccagagcttggcctccgcgatcccgcaagtcatcaacataaggattggtaagtacaagataatatgatagcggccctgtacttctaatggtaaagcacttaaggtgaaaccgtctaacaaaagcgctgccattagcaaatagtggttaagatagtgttgatgccatagcagtcccagccccattaaaacactgaataacgcaatcaccagcattgcctgccaataaaccgtcgcacttgtaatcaatataggggctaaataaaaccagtggcggttaagcaaaccgggatgatggcttaagttatataagctccaatcatagccataatcctcacgaataaagccctgcattttttcattaacaaatgaccccaactgtggcttgatttgtttgagattagtctgcaaagtcctcgccatcgttcgtgtgattcgcggataggcttgcgtcaacgtgggcgccacccgtaattcgtggctgacggtagcttgtagtgccgggctataggtcccgtgacttttaacatctgtccccgtagccaggctgtataaagtttcaacttgggctggcgcaaccttaaagccatataaccagctgtcgagattagtcgctgtgaacatgagccctaacacgaccgcaatgtatatgaggagctgacgtacttgaacgcggtaaaggtggtgagacttaagcaggacacacaaactcatcaaacccagtgcaattaaccagacgcccatgattggcctcagcatattggccacgacagtcatcacgatcgctaacgctaggtatagtcgtcgatccgtgattgtggtcgtcgtgagtggaactaatgcccgcgtcagcgcatacatcatgagtaggacgctggtgaaaaagaacggttcaccaccatttaagagcgtgccgtacagccaataagctggaatccagtaaaaaatgagggcagccatgatgcctaattgtcgtgagagccaacgtgcgactagccagtaaattaagaccatatcgactaaagtacacccaatattgattagttggctgacaaaaaagttggccccgccaaaagccgcgactaaactgtagccgttcgcgatatttaaagcgtgcggaaaaacgacgtaattgccaacgataccatggtgtaacagttgggtccaggtgaatccttgggcactaaacgcggctagtgtatggtaattccagaaatctgaggtcgggtcgatctttaaccctgcaactagggtccgtcttaaaa

SEQ ID NO: 97 - DNA, 7715 bp, Lactobacillus plantarum
ttttgtctaacttttgtgttgcactttacggctcatgctgttttagactcttttttatgcaattttgtcttagtttttaataatttaatgcgctttaaagtagttttttatgatttgctttttattaatttgctggctttaatgaaatctcgttgtatccagaatgagattagcagtgccaatagatcaatcaaaataaaggcagctaatgtcaaagtataattgtggaacagttgatgtgttaatgataatagtaatggtccaacaactccggcagcagcccatgctgtcagtacatatccatgaacagctcctaattctttagtaccaaagacatcacctaagtaggctgggatgacagaaaagcctgctccataacaagacatcaacaagcataatgcaatgacaaataggagcggtaatttgaagatgagcatggctgaaagcattacaatattgagaataaaaatggcactgaaagtagcagggcgcccgatataatcagacaaagttgcccatatcaaacgtccaaagccattgaaaaggcctatgattccaaccataattgcggctgtttggacagacatgccggtcatactttgagccatgggggatgcagctgagacaaggccgatcccgcatgtaatattgataaagaacattatccaaagaaaagtgaaggatttagttttgagggcttggttagctgttagctccggtcctcgggttagacgtgttccctttttttgagaaatgctattttcagtagtgcttgatagtgccagatttggacgaacaataaactgtgcagcgagcagcataataacaaaataaaatgttcctaagagatagaatgtttgttcaagaccaacactagccattagctgttgagcaacaggaccagtcagcattgctgcaaaaccaaatcccataatagctaaccccgttgctaaaccgcgtttgtctggaaaccatttaataattgttgatacaggggtaacgtatcctgctcctagtcctaagccgcctatgacaccatatgagagatataatagccaaattgaattttgatggatagcccaaccagtcataatggttccagttccgtaaagaaagctagcaatagttcccgttagtctagggcctattttttcaacgactttgcccataaaggcggctgacattcccaagaagaaaatagcgatactaaatgcaagagcgactgaggattctgcccaaccattttgttttgcaattggattagtaaaaacactccaagcataaacggaaccaatcattaaatgaaacatgacacctgcaaacgcaacaacatagcgatttgttttcaagaccaattcctccatttttgatagtatacgaacaatttaaacgtttttcacaaccattgttggcatataagaataatatcacattgattatcacatttaaacaattaaattttagtataagacgaattttaacgttggctaatgaaaagtacatttaagttagctatagtactgggaaaaaacaaattacggttgctgtttttgaacaaaaaaaaagcacagggaacctaaagtgctccataattgttagacaagaaatctaacagttatggagcactttttctatggtcaaatatagttcagaattaaaagcagaagtcgttagtgaatatcttcaaggtgacattagtatcagtcttctttcaaagaaacgtaacttgcctcgaatacaagtaggtagatggatacaaaactttcgtttgagcggcgcagacgctcttaaacgaagaagagttaaacgaagtttctcagttgagtttaaagttgatgtgataaactactatcaaactcatgatgaaactttagccgaagtatccgcaaaatttgatgttaattcttgtcaaatcagtctttggaggacagccttcaatcagtatggtatagaagccttgaagcctcatccgaaaggcagaaaaaccaaagtgaaacataataagaagaaattacgtaagttagtaaacaagaacgaaatcgatcaacttcgtgaagaattgacgaaaaagaatcaagaattatatgatgcaaaattggagaacgaaatcttaaaaaaatcaatgaccctgttcggaacctcaaaggacgaaagaaaacacaaatagttgatcagatcagggtcgaacaagagtctcttccgaaatctaaccggtataaagtcggcgatattcttaagaccattggacttaagaaagcgacttatcatgatgaacgtaaacgtatcaaagattatgtagataagtatgaagatgtaaaagtagagatactaaaaattgctgaaagcggaagatatcgcggacgtctaacctacggctatcgtcgcgttcaagaagagctcattaaattagatatccatctatcagacgccgtagtgcgtcgtttgatggatgaattaaatgttcaagtaagcctttataaccgccacagaaatggtagatattcatcttataaaggtacagttggaaaagtggcccgtaacgttctacatcagcattttaatgaaaccgtaccctttcgaagtattacataccgatgttacacaagtacgcttggccgatactaagtgggcttacgtttcagctattactgacgaagcaagcaaggaagttttagcatttcaagtaagtaatagtcctaacagtaaactaattatggatacactcgatgaactcacagaaaatattccggaaggaataaaaccaataattcattcagatcaaggttggcattatcaattgaattactataccgataaactctctgaaaaaaaattatacaaagcatgtctcgtaagggaaactgtcttgataatgcgccaattgaaagcttctttcatcttcttaaaacagaatgtcttaatggatttccacagtgtaaagatatgggagaattcaaggaaatcacaaagaattacgtcgatcggtttaacaatcgacgaatatcacagaaaacaaaaggcatgactccctgcgaatacagggaacatgccttagcagtttaaaaatattcaattttgtctaacttttgtgttgaactttaaatgaggtgatctttttgaatcttttaagaaattatagctgctaatgcagcaccagtccgagagtttttatcgtttaggctatcttttggatgaccttcaaaacaaacttgaccgccgaatttaccagcatcgggtcccatatcgactaaccaatcggctcgtgaaattaatttcagattatgttcaatcagaattaatgtattgcccttatcaaccaatccttcaaataaatcgatcaattgttgagtatcctgtaagtgcaatccggttgttggttcatctaagaaatagattcggccggtatgattcaattccattgctaacttaacacgttgcacttcaccaccagataaagtggtcatcgactggctaagattcaaataaccaagtccaacttggtggagtagactaacctttttgtagatatctggcacatctttgaaaaactctaaagtgtcgttgatagaaagatttagaacctcagaaatatctttgccatgataagtgtattgtagtgcttcttggctataacgtttcccatgacacaactcacattcttgaacgattggatccatgaatgccatctcggtgatcatcacacctttacctttgcaacggggacaagcacctttaccgttataactaaatagttgtgttgaaacgccattgttggctttactgaaaagctttcgtagaggatttaaaatgttcaagtaagttgcaggtgtagaacgaatattcaaacctacagaatcctgactcaaatcaatatagtcttgatcagaaacttgttgtttgaaagcttggactaaagtactttttccagaacctgctggtccagatatcacggtcattacaccttgagggattctggtagatacgtcttttaaattatgagaagttacatgattaacatttagccaagattgaggttcacgaggctttgggaaagtgattttttctcgtaacattttacccgtaatcgtatctgaccgtaatagttcgtcgtaggtaccagtgaaagttacttgaccaccatttttgccggcttgtggtcccatttccacgacataatctgctgtcgaaataatggcagggttgtgatcaactaggataatggtattgccatgttccttgagcttttttaaggattgggtaattaatttaatatcgtgaggatggagtcctacacttggttcatcgagtacgtaaactaaatcggatagggaactcgtcaaatatttggcaattttaattcgttgagcttctccaccagatagagtatcagttccacggccaagggaaagataacctaaaccgatgtcgaccaaagcttgaattttactacgtagttcacgcaccattgttttagccttggggtccgagatattatccaaaaattttaggacacttactaaatccatatcgctgacttctgcaatatttttgccagcaattttaccagttagagcctttttgttcagacgtgttccatgacatactgggcaaggttttcgagtgacaatctttgataaggcagcttcatgatgacgacctgaggcactatgaataacagagcgaagcatacgtggaactagtccttcatataatgccgtacggccccaatttgccggtggattttttaatttttgttgcggagcgtgcatgaataaatcatattcttcatcggtgtagtctttaatttttttgtctaaatcaaataatccactgttgccatattccttccaacgccaagttcccggttgaaaaccggcaaaagtcattgcaccttcattgagtgatttattaggatcaattaattgacgttcatctatgtcgtcaacaaagcctaatccctgacattttggacacattccctgaggtaggttaaaggaaaaccattcagaatacccaacccaaggctgtccaattcgagaaaacatcaaacgtaagacggaatagatgccggtgtaggtcgccagagtagatcgagaattacgaccaataggcttctgttcaaccacaattgccactggtaagttgtcgattcggttcacttcaggttgaccgtatttaggcaaatattgttgggtgaaactaggaaaagtttcattcaattcacgtcgggaaacagcggctaatgtatcaaaaactaaagaggatttaccagacccagaaagaccagcaaatacagtcgttttatgcttaggaatatctaaactgacatcctttaagttattttcttgagctccatggatagagatagtcccatctgcaaataaatcagtcataaaaacctccaacagtaaatttataattccattatatatagaaatctcgtttaacaaaaataatcgggtctagaatttttggtgttggaaagtatttccattccaaaagtactaggccctaatttaaaaagccattgataatggatcaaaaacgtccactagggtataccctattggccgtttttatttttgtgctatactaggaattacaagtgttcattagaactgtccaaaaggagaattgaaaatggctaaaatcggttatgcgcgtgtgagttccaaggagcaacatttagatcgacagttagcggctttaaaagacgttgataaattatttacggataaattaagtggggctaacactaatcggccagaactgcaaaaaatgctggcctatattcgtgagggtgatattgtaatggtcactgaattagatcgcttaggcagaaacaaccaggacttaactaagattatgaacaccattcagaacaaaggtgccaccctagatgtgttgaatttgccgtccatgacggggattacggatcctaacttgcgtcaactgatgactaacttaatcattgaactgtataagtatcaggccgaaagtgaacgtaaacgaattattgaacgtcaacaacaaggcattgccctcgctaaacagcagggcaaataccatggccgtaaagcacaatataaccaagatgatccccgcttacaacatgcctttaaactatatcaagccggtatgagtgatgtggacgtggcccgcaataccggtataaagcggacaacttttattcgttatcgaaagaaatttaagattgtgagaggtggagtacatgaagccacataaaattatcctcacttgttttgcgcttcttgttttgggagtgtgtagcctagtaataaacacctcggctaacgcagcaatctgccataacggcggccgggcggactaccgaggattgattaaatacactaaggcggccaaacgggctaagtcccacgttgagtgtgatacgattttgatagatcaagacagtgccagcgatactttcccggttaacgacatcgaaacgagcgacggtacgattgaacacgaggctcacgtttcgaaaatctctgaagcccaactgtactacttgaaaagtcggggattagacgaagcgaccgcctcccaattgattattatgggatttttggagcccttcactaagcaattgcccatggaatacgccgtggaattagaccggttgattaagtttcagatggagggcagcatcggctaaagctgtgaaatttgcgaacgttatgcaaaattttgcccaataaaaagaacggcgaattaacgccgttcttaaacgattgataataaaattaaattagaaaacatttttaaataataaagccaaaacgtgctcccaaagtcagtttgcgtcgcttaataggtaattggtaaccatgttcatgcataaccaacgattccttgttaatgctcacgaactagccgactttgggggtgcgtttttattttaaaggtggaaggcggcttgtacacccacgatcagcattttgacgccgatggttgctaaaatcagccccattaacttggtgatcacgttcatgatgttgttgcccagcttgtccatgatttgttcaccgtagataaaaatgaagtaagcaatgactgctaaaacaacgaacgcggccacgacgatgaaggggttagttccactagccaagttcatggtggtggcaatggttccggggccggccaaaattggcatggctagcggagaaatcgcgacgttggtgttactactgttgacggaatccttaacggatttttcggtatcgtgctggatcggcgaaacgttaccttggatcatgtggtaaccaatcaaccccaaaatgattccgcccatgatgcggagtgcagcaaggttgataccaaaaatggtgaagatgtaatttccgagaaaggcaaacagtaccacgatgacggtcgccacgataaaagccagtcgggcaatcgcgttgatttccttgcgactgttatcagcagtcaaactgacgaacattggcaagttagcaaaggggttcataattgcaaaaaatgcggtgaatgaaagtaaaaatgcttgaactaaatgcatggtcgtcctccttgttaaacgttttcaatgcaatgattgttttttaattatatgggttaggtggggaaatgccaagtttggtgatttatgtaccgttattgaaaaattagacaataagtcatattaatattgttcttctaaagagatggtagattgcaaatttaat

SEQ ID NO: 98 - DNA, 4411 bp, Lactobacillus plantarum
cactggcatggaagtaccgattaaacgctaacccgtaccgtacttgttaaacaatttaatgaatgccaaataagcactgcccactattttgtgagcagtgcttatttgatacctcaagtctaacacgaacaattatcgcaatgagtcggcgttgtcatgaccgacaactccaatctatttgaatgttactttcattactgattgaccatgctgtacttctgttgaccaatcttcagtgtgtgctgtaacgcgaccaggttgcgtaaagaaagtaacaaccacatcgtcataaccactctgtttgatcagatcacgatcaaaggtcatcagtaaatcaccagcgtgtacgacttgcccatcttgacaataagtcgtaaagccagcaccacggaggttaaccgtcccgattcccacgtgaataattgtttcaagaccgtcagctgacacgattcctaacacatgtttagttgagaacgtaaaccgaatcgtcccatcgaatggcgcatagaggcgaccatcacttggcctgatagcgaaaccaactcccggtaagccttgtggctgtgcggcacttttgacatccgctaatgcgagcggttgaccgcttactggtgctaagatttcagtggtcagaatgtcagatgcaggcgttaccgcaacatccactgcttcccctgttgccaatttggcctgtaactcttcaacaatttcggcatgtttcttttcggtaatggttactttgaatgtaaagactaacaatgacaagattgcacatgctaacggcaagtaaaacgctgtgagttcaaacgtatgaatattacttgcagtcatatcggcggccgttgcactaccagtcataccagcaactaaagcaatggcaccgacgataccgttggaaaaggcaccagtcattttgtcgatcatcggccgaacggcaagcaccaccgcttcattacgattgccattcttcaattgaccgtattcaatggcatcggtcattgataggaccgtgactaattgggcaaagttaatattgaaaaggactaatccgatgatcaataaggtcaaattcgtctgcgcaacaataaagataatataggctaaaatcattgagcattgaccgagtgcaaagagcactttccgtggaataaaccggttcaagattggatatagtggtgacgtcacaaaaccgatcacagttgcgaccgccccagcaatccaaaattcaccaggtttaccaatcacgaatttaaaaagatagaatagaaccccgttggttatcacgtttgctaatgaatagagtaagtaacccagactgacccacataatttggtcattcttgataatgcccataaagacacctttgatcgtcgtcttttgtttggctgcttcccgaatcgcattgtgcttctcactggttccaaaggcgacaaatagtgcggaaatgactgccacaataccgacaataacggcaaacgctagccagccttgtggaccttgggtatgcttaccagttgcgataaaggtaaagtacgtggtaattggtacaacgactattgccaggccgttccaaccggtcgtcccagcaaaattgccaagagccgtgagaattccccgggcatgactatcttcactaatcgctggaaccatgccccaatacgagacatctgttaacgaatagaagacatccaagataataaataaaatcgcaaaaacaattgtaaataaaatccagtttacctttgctaatccaaagattcctgagaaaataacgactaataagaccgaactgataatactcccaatgacttgccaaggcttaaacttaccccaacgtgtttccgtattatcaacaatattgcctaagattggatcgacaacgacttccgctaaacgaatcaccaccaccagtcctgtgattaaaccaatcaaccgattggcgatagctggtgcaacgccgctaaacatctcactagtgacaaagacaataaaataggtactcaacgcaccatagaatgccgagtgtcctaagttacctaatccaaaggcaacgccttcattaatttgatgccatgataactttttcttggttactggttgttgttcaaaattttgtgccattaatttcactccacttaattatttattcatcatatagacttgaacaccatagctggccaagtcttgcttgccacttaccacttgattctcaaaaatttgccgtaacggcacttcaagtgtcaccgtcgttggtcgatgactaaaattgatcacgaagtaatagcgcgtcgtcgcattctctctaacttgaatacttaccttggcattcgctttgatcactggcaatgccggtttaagtgccaagcttgtggcaagccgtttatagaaagcatccaagaagtcagtattggtccgcgcagccaaataatacgccgctccctggcccaattgattgaccgttacagccggtgttccagcataaaaatctttttgatacgtgccgaggacttgtgccgttgtcgtctcaactacatcacaataatcattcacttgatacgcttggtgataagcagtcagtgcattatgttgttgcggatataatgtgtcagtttcctgaactttaatcccataagttgcttctaagtcagctaaaccatcaccttgataggctaagaagtcatgataaacgacgcccgtaatataggtgccaatcagatggccgccctgttgcacatatgctttaagcttagtcgcaaaccgggcgctcatcatgaagtgcatcggatcaatcaccaaatcataagccgtcaaatcatcagtaatcgcaataatttcaactggaatgtcatgttcccagaaatactggtaatgttcttgaatcgtgcgccaatactttttagtttcgttagcgtagttgcgggcatcatccaagccccacatgttgtcataatcaaagacaatagcgactttagctgcagttctggtcgttccatgcgcgacctgtaagctttgtaagtcctgaccaactttttgaacgtccttaaatgcccgcgtatttgagccacgatggttggcaatgacggcgccatgaaacatttcagaagctcctaatgattgatgtagttggaaatacaaaactgagtcggcgccatgggcaacctgttgcaagctccccatttcgtgcatgcctggtcgtttggcacgattatatgggtgccaattaacctgtgacggtgtactttccataatcaagtagttatcatgcttgaggatccgcatcacgtcattcatcaaagcagttttcatggccagtgggccgtactttcgtaaccattactccaattaggatatgaatcccaactcacaatatcgacatgcttcgcaaacttctgataatctaaatcataaaagccgtgtgattctgatggtttgccacccataaaattggctgtcacagggatattaggtgtcagcgctcgtaacggtttgatctcattatcaaaaaagtcaatcgtccggtctgttacaaaacgatgccaatccaggttaagtcccattacattcgtatcacccagcggcgacggtgcctgaacctgatcccaacttgtataatcgtggctccaaaaagcaccacagtaagcatggttcaaattggctaacgtttgatactttttttgaactcaatgacgaaaggcttgctggcacaaatcacagtaacaagcaccgccatattcattagagatatgccatagcagcaagcttagtcgttgaccgtaacgttccgccaacttctggttaatcatttgaaccttttctcggtaaactggcgatgtgtaacagtgattatgtcgctcgccgaattgatttcgctgtccgtgttcattgacacgtaacactactggatatttctcagctaaccagcgtggacgagccccgcttggcgtcgacaaaatgatcttagtcccttgggcttcggcacgatcgaaaatttgatctaaccagctaaaatcatactgcccctcagcaggctctaacttgtctcaagcaaagattcccaatgtcaccgtatttaacttagcagccttaaacgctttaaaatcctgcttaatcacctcgggttggtaaagccactggtctggattataatcaccaccatgcaaaaattctgttgtctttaatggattgaacattcaaacgcaccctcacttctatcaacttaattacgctttaacagctcttatgatagcactttcatttacgaatgtaatccgttttactaaaataattactaaatacaagtaaacattatttacgttttgtttatattcattactgcttttattagcgctaatgaaagcgcattattataagtgaagctttttacgctctcagaatagtccatggtgttggt

SEQ ID NO: 99 - DNA, 7489 bp, Lactobacillus plantarum
ttaaatttgcaatctaccataaactcactccaataagctaatataaatatcattataaaccaatgatgccataatgctagatggtgtttacacccttatgtcctgattgaacattggaaagccttatttaatcaggactattatgaattttagtcgttgaagaagtcgcaaatcaggaagtaccattgttccaattttacagtataaagttattttgataatcaacaattgctaatcaaacattacctagttatcattaatagccactgttttcaaaaacaaacgaaactagggtggtatatttctatccgattaacgacagtcgctggtatacttttattcacttgtttctctattgtaaggcccttaaactcctagttgtacctaattcaaaaggagtgagtcctattttcaatcaaatcactatccataaccaacatactgaaaattggcttattattggccttttctgtggggcttttgtgactggtgctgacgcatttattatttcagcactactccccgctatcgctactagtctgcatgtgccgactaacaccgcggcatacggagtcaccgtttacgcactatgttatgccatcggtgcacctttattcggcccattaggtgaccgctttaataaacgttttttgctaatcagtggctgtggcatcttcttactaggaacactactctgtggattagcaaactcattgctaacattctatctttaccgtgccatcgctggcatcggtgcagctttatttatcccaaacatttgggcttttatcggtacttacttcaatggtcaacgacttaaccaagtcatgggcatcgttatgtcgtcactttcattatcaattgctaccggtgtaccactcggtgctttactagcacaactcagtagttggcatatggccttctggggttcagccatgctaaccttgattgcattatcgattttgaccattgccataccttcattaccgagtcagaatgcccagcctgacggttattttacaagttttaagacattagtccacactcctcacgccatcgctgccctactgattacattaacttggatgactgggttctatggcgtttataccttcttaggtgtttttgcaactgcgacctttcatttcaacacaatacaaactggtctcatctttatcacttatggaagtgctaattttgttgcgagtttctttgccggtaaacttatatcattgcttggtaaaaaacagagcgttacaattaatggcttagtttcagctacattagtcttatccttaggcatctggggacaacatttagcagtattgctgattattctgattgtgctcgccttatctcaaggctggggtgtcactgcattaactgcaacaatcgttaatattgtgccatctaatcgttcaaccatcatgtcatttaatagtgcttttttatactatggcttaacgttaggatctgccgctggtggcctgcttttaactaaaattggcttttacgcagtgacgattgcagcggccatggccttattaggcgcagtattgattacaaatgcacttagccactattcggattagctttgagacaatcagcttttaatgcgtattaaaaaactgctccgagtcaagtagacagttcaaataattaaaataattaaaatagctatgcagtttttagaatggcatgattccgaaattctttcggggtcatgccatttagtgtttcttggcgacgcttgtagttataccagttaatacatttttcgataagttgaaccatttcttctcgatttaatgcatggtgaaaattaaagaactcggtcttcatatgactccagaagctttccataggactgttatctccaggggttcctggacgcgacatactatgcttaaccccattgctagctagatgtttgttaaatactccagatgtatagcttgatccctgatctgagtgtaaaaccgttggttttgcaccattgcttattgctaatgccttatcaaatgttcgagtcaccaaatcggctgtctcagtttcttcaatgtcccaagcaatgatactgtggtcgttcaggtctttaatcgcactaagtctcaaacgttcactgaatttccaaccaaaacgtagctctgtacaatcagttacccagacctgatttggcttgtctggcttaaaattatggccttcatctgaaaggaggaggttattgctgatgtgctctttccgttgagcttttcgatcatgctgtgccacgcgaattgaagccacgataccattttcacgcatgatccggcgcatttttccagcactagttcgatatgttgtatcgcaatgaagattcatcattaatcttcgtactccaagggtatattcgttctcctcttcaataattttgacgtactttaatatctctttatcttccagagcacgtttgcttggggttcggtgtatccatttgtaatatgcagcacgtgagactttcataaaacgacacataaaactaatcccataaacttggtttgtatcagggttcaccgtagttgctaaagtttggattgtttcgtagatgtgtgatgagtggcatccaacctttccaattcttggagtttttttagaactgcattctctgtcgataaatgttcaattcgggcctttagacgcttgacctccaggtcacgcttctcgttatctgtaagctggtcatgcacagtctttcccttaccacgacgatcgacaagggcttctggtccaccttgtttaaacttccgagtccacgagtaaacctgaccatatgacacgttgtacttattcatggcgcgtgagtaatccatatcgtttgctataatccattgaacaatttctacacgttccagctgggttgttttccgaccatctttcacttgtttcacactcctagtggtgagttgtttaccactagtatactgatgaacccattgatagatagtactaacgttaggaatattatatttatcgcataatagaggataagaactgtgtccttctaggtactccagaactatttttaatttcaattcacttggatactttcccatgagtcgatgccgcaggccatcgatcccctgtaatccataacgctttacccatcggcttacttgactatgttcaactccatattttctttgaacggcattaggagccattccctgagtaactagaccaatgtaaaacaacttctctttaatcgtatagcgagaaccttttctgcccatagaaaaactcctccttaggtaggcaagctttgattatttgcttgtctacccaaagaggagtatatccccaagattcctgcgagcagtttttatgattgttaaaaatagtggctaataatgacgtcctatacttagtctaagcattgaccaatcgactacgccaactgtaacgtttcaaggtaagccttcccccatcgatccattgctttaacgattggaactagtgatactccaatgttcgttaactcataaactgaatgattagcgaccgtttgttgactcacaatctgatccgcaactaattcctttagttgcatcgccaacattcgactggtacagcccggcatgccttttaataaggacgaaaagcgctgcgaactccccattaatcgacagataataattgatttccatttacccgacaagatactcaaggttgtatccaatggacaaaattcttcatgtcgccgactgttctcaattggtgtaattgtacgcatctcgccacctccatcgaaaattgtatcataataatattcttggtataactgaactgtttaatattattaagtgaccaaacaatgattaccactacatcaaccacaccgctattaataaaacaggcagcgcccaaaatttggacgttgcctgttttaatcattacacatcacgcgactaatacgcgaatgtcaaccgctatgtcggtaggataacctgtgttaacgtgaaagcaaagtcaacatgccaaccatggctaatgaattattgataatgtgcaaggcgacactatagcgaatatcgttgaaccacacgtacgtaaaagtcagcacgacggcgatcggtaagtaggctagtagcgcagggctaaatgataacgtatgggcaagggcaaatactaaactcgcaaaaactaatgcaaccgtgaaactcacccaatttgtgacccgcggaaataaccaacgatacatcagcccacgaaaaatcagttcttcgacaatcggtgccagtactgccatcatgacaacattaatgactggactagtagtaaataccttatccaaaatcacttggttttcagggggttgtttcacgataagtcccgccaacacgttacctaactcaaccaggataaataggcccactatcgttaacaccggacgtgtcggtcgtgataaactggtcacgattggcgcttgacgacgataaatcgttaccagccaccaaatgagtaatccgagcaagactaaacttgccactccggcaattagtgttgccgtggccgagaacccgtgtcgaattgctggcatcatcgtaggaatcatagcgagttgatatagtgcgaatagaccaattagtttaacgatattgaggagccaggtgacaatagaacgattcgacttcaaaattttccaacctccttatgtgtttgcatcagcttttcagctcgttttgggattagtccgccaagctgactaaacatccactagtgtccttgtcataataccataatgaagaccatttgattgtgaacaatcacctcttcagagtgaaattatgattgcactatttgaccagtctatcttaagaaactacaatcatcggaaaacagtgatcgttttaagtctaaccacctatttttaattatttatctgtttggagaactctgccgatattccaaatcatactaattctcaaatcattatctccgtatatattaaagtgagaaaaatcgtatctaaatctagtagcatcctaggaataaaaccatcatctagataacacttgatactaatctattttgttccaacaacctgaatgcattataattaacaagcgattaatttatatcgataaatcatgttttatattaaatagtttatttaaataagctatttcttaaattttttatttaaaaatataaattttacgtttaaatattatacaatacgttcattgggagactataacatgccagcaaaaacacaaaacaacttcattcgaagactaattaaccttcgtgacagtcggaactggtcaaaaactgaggtggccaggaaattagggttgagcagtatgcagcgatatgccaactatgaatatggcacgaatgagccagatttgaacatgcttaaacagattgcagatctatatgatgtgacaaccgactacctgctgggtgaagatagcgcatctaaatggattgctagaaaagataccactgacttaaaagactttctcacagctcatgtggattcgatgacatacggaggcgaagcacttacggaagaagaacgccaacaagtacgagtagcaatggccgtcatcttctgggaatagggctaaacgcgactaacgccccttacgatgaagtatcttaatgttcgaaccaagttacttcgggcacgcttatggaaagcttatttatcggccagaatattggtcacctttgtttatttatacgaaaaataagcctatcaatacggggattaatggtttgggtaggcttcaacaacttatgtccaataaactgatcgacacgaaaagctgttaataaagggaggagcttcaacatgaagtcaaaaaatttagcacttactaacgggattgtagggctagtcggcggcattattttattattcgggggctggtttattgctggtggcattgttagcgatgctgccactggatcagtatctaatacatcaggtgcggccgctttcctaaacattttgaaaattgctattttagcattaggaattattgcattaatttattataaaggtgataagcgtgtcggtactgcatcaggcgttttactaattgtcggcggcgcaatcgcgcttattccattcttgggttggattggcggaattctcgcaattattggtggatctttatatttagcttcattaaagcattttagtcaaccacaagcatagtctaatctgcaatcagttagtaatatcagcccttaactgggcttttattcaggcccaaaaagaacgtacgttccaattgtgcaaaccatttataaaaggccgttacaattaacgaattctgacaagtcttttgcaattgcaaagcaaaccaaatttactcagtgctatgcacacatttctcaatactgacattcgaatgcccgttggctaacaaagttaccaacaatttgttaacacttcaaagttcatagcgactactatcaccgggtttatcgctactgctcttagaaacgcccgtggaacgttaactgatgaatatagaataactatccttaccggatggattcgatatgctatttaattctgatttgacatacttgcgataaatgccgataagtacacttgtcagccagcgtttaagctgaatcaatccttcaactatcataaattctgacaatgcttgaaaaaattttaaataaaatttttattgatatgatgtatgtataaaagcaagaaaaatgtatgcttactaaaacttgagagaagatgaaaacattttgaaaactcacttttttacagttcactctgtcgacagtaatacttacgatttaagtaatatcaaaatatattttagcttcaatggtataacagttgaatcaattagtcgtgataaaagcactgtaattgcagttcgtggtgaattgaatatagacccaatttattcacaagtagaaacttcaagactaatgagaccatggttacttgtcattcaagggataatttctctatttcttgaatgtcccatcactatttatgacattactgaatcaggatcctctttcgtggttaaaaatggtatcgacaatcccccaaaaactatttttcaaaccgaaatgaatgactattcaaaagatttagaaaaagtattatttaaaatcaatgattcaaagtataaaaacctttctatttctctactcgaccgatggcgcaaaaatctcaacctagagaatgaggatttagaaagcaatttatatcgtgatgaagctttacttggactctttcaaattttagaactattgagtaacagccgcgaagatgaattaaagaaaattgcggaaagcaaaataaagtcaagtttgaaagaatatgcttcacttatgctaacaaggaatgacgaacttgataactatgttaacgataaatataagattgtatcaacagctctaggcgcaaagagccctaactttagcacaaaaataaaatatttggtagattgtaaaa

SEQ ID NO: 100 - DNA, 4071 bp, Lactobacillus plantarum
taattttacaatctaccataactgctatactaaaagtgaaaagaagaggaatgatcgttttgaaattgtatcaaagccttacccaagtccaaatcaacgaacaattcgctggtcaagcaaccggctacaagctttccaagacccttgataagccgctgaactacgatccaacgattctctatcagtatttggataccgtcctgaaaccgggcagtcgccacgacgaaaacaacttgcgctacgtgactgatccgggctatatcggcgaaaactttaattaccaaagcgtcccgtttacttcgcacatgaccgaattcgacgagaagatggccttcgcacgcaaactggtggccgaccttaatcgtcatttatctgtcaacatcaaactggaagatgaaactatcgaactggtctttgttgactaaagcaaccgtgttgccctcctttcctagtcgcgatgcttctctcctgatcatttgcgtctaagtacccagtcaagcatgcttagttgcaacaaaaatgaccgtctactttttggtaggcggtcatttttgtagatgcaaagcacgaattcgcagctataccgctttcttcgcgacttcctttggtaacgtcaacgccaacagcaagccaatcaggcccacgccagcaaacacagcgaaggtaacagcaaaaccgccagcatgacttcgcagcgtggtttgcatgccatccaacaacactgtggcgaacatgacaccggcagaaccgaataactgacgagccgtcgttgtaaccgcagtgccgtctgccacgagcgcattcggcaaagcattcgcgccagccgtcactgaaggcatcatcacaaaggcattgccggcttcagtcgccatcgccaacataattgccccaatcagcggtaaatgatgggcaaagactgctaacagaccaaagccgccagtaatcaacaacatgccaatcatggccacgacacgcggtccaaagcgatccagtaggcgcccgctaattggattcaaaatactcagcaacaccgcagctggcactaaggacaagccagaaatcaacggtgacaaaccaagtagcgtttgaaagtaaagcggcatcaggatagtggtgacaatcaaaccgacgtatgaaattccggtcagaaacaccgctttagtaaacataccagtggcaaaaactcgcatttgcaacattggtggttggcgattcaattgccgaacaacgaaaataccagctgccagaacgcctaaaatcaacaaaccaaccacgccaacagttaagccttttttcgacaaagcacccaaggcataaagtagaattggaaaacttgcggataaaaggaaggacacccagtccagttgcgtcggttgcaatggcatgacagacgcaatggtcaccgttgaaacggccagcacaagcagcgaaacgaccaagaagaacaagaataaagcctgccaagggaaccatgtcagcaaaacaccggaaataatcggaccgactgccaaggctgagcccatgaccaatcccgccgtgcccatcacccgaccacgctcactatgcggcgtaatcgtcagcaacacggtctggaaactcgggaaaataatcccgaccgcaatcgcttcaagcaaccggccaatcatgagcacggtaaaactcggtgcccagatacataagcctgtcccaatggcaaaaatgagttcaatcgcttggaaaagccgttggaaagtaacattatgcaacagccatgggctaaccggaatcatcaaggtcatcaccaacataaagccggttgtcagccaagcaactgtatccgctcctaaaccaaaagctttcataaaagcaggataagcggtgcttaaagaagactgagaaattgacatcgaaaaggtacctgtcagtaacgtggcgacaaaagccccgcgatgtttgatcgttggagagtgcatattaaaatcatctttttctatattagtattgtgggacgtttacattttcattcccattttttcataagactgcataccgcccatccaaatctcagatggtttgacgccacgttctttagccaaggccatcattaacgtatccatatccatcaatttatattcttgctttggcttggctggatcgaatgtttcaatctgtgccatcatgccgccatcttcgtgctcaatgatatggcagtgatacatataaacccctggcaaatcaaagcgaaccagcagccgaaccgtttcaccaggattcacgccaacggtatctttgaaaccatgttcatttggatacggcgcatgcccattccgcgacaagactaagaattgggttccatgcacatggaatggatgaaccattccaggcgcatcattgctattggtaacatcccagtactgggctttgccaattggttgcgtggcatcaatccgctgcatggcaaactttttaccatcaatcgcaacactttcgtccatcccctgcatcacaacgtggcgaactggcaaagccgggtcaaccactggtgccttcacatcgaacaacttatcaggcaaggtagtctgatccggtttgaacgcatgaatgcggaactttagcaatggcacatcatccgtatataaggtgacctcgtcgccttcatggtattggccaaaatcaacaatcacttcggcacgctcagcacaagtcagcatcaaatgggtaaatttgaccggctccggtaacagtgagccatccccgccaatttgcgtaaatggcaggtcatcggaaaaatgcaaccgccattcacggcgattagcaccatccagaaaacgcaaccggaccttttgcgtggtgacatcaaaatagggattgattgtaccgttaatcattgcagttggcccagcaacaccgtcaggatcataatcagcccggtagtcccactggttgttctcatgaaaacgccggtcttgcaaaatgaccggaatatcgtcaacgccatagttccttggcaatggcaggctggcttcatggtcgtctttgacaatcaccatggcagccaaaccatgccaaacctgctcggctgtggatgggcacggatgcgcgtgcagccacaaagtcgtcgccggttgttccaatgtgaagtcgatatgcttactttcacccggataaaccggcgcatggcatccgccatcaacataagggccactgacattagccccatgccaatgaaaagtggtcaactcaggcagggtgtttttcagtgtcacatgcgtatgctgaccacggcgatacacaatcgtctgacctaacagactggtattatagccccacgtcttggtcttcgccccaggtaacagttgcgtttccccagcctctgctgtcaccgtgtaataaacgtcggtcgccgtctctttatccggtttcaacaacggcggcacatttaagggcttatcaggcgcatcactgacctcaagcggcacgtacccgccatcgtggagatcaaacgctggctcatcaaagaaatagtccgtatagtttttcatcgtgatttccccctctgacaagaattttaacactttttagggttgccataaacataatttagaattaacctaaagtagtatcgaaaaatggtataggtcttatccatacacttgaggaggattttcatgcaacaaatgtcgaaaacaatgggctggctcatgctggcgttaaatgtggtgctgctgattctaattggtaccatgcacaatatggcagcgatgtggttaatgggtctgattatgactttggacgctgtgacagggttagttgccgcttatcggccccagtcaagtcaacaacacgcccaccagcactagtttgttaagaagttgctgcaagacctttcatggagtcattgatcggcgttatatgttaacatatacatatgttgaatatatcatgtgtctgtacttagatgaacagtcacatgaaagagggtcgtttaatgcagcaactgtcaatgacgcagaaacaaaccatgacgtcagccttacgggttgaatatttttcaacggcatggatggcatttgagtggtagattgcaaattt

SEQ ID NO: 101 - DNA, 3897 bp, Lactobacillus plantarum
ttaaatttgcaatctaccgtatatcaaaaatcatagatcttggacagcttcttagtaaaaatagttgacttttgagatgtttaacattacattattaggtaattgattgacagtcatttgaatttcacaatgttgaagagaagagtacgttgttgggctgcacaaagcgaccgctgatagtgaaagagcgggcagacaatgaccgaaagtgcgctcggagttgtggcatttaattaaagatgcattcgaaatgaggcgttttgtttttgacaaaacgcaaaaaagggtggaaccacggtaattcgtccctgatgatcagctgatgctggttatcagggacgtttttgtgttcaaatgactgcaaaataacttgtgaggagatgattgacaatgagcagctgggccgttatccaacagagcttaccgatgtttgagaaggggtttcaactcaccctgtggctttctttcgtcgggattattggatccatcattgttggcataattgtgagcctgcttcaatatttcaaagtaccggttctacatcaagtggcatcgatttacgttgaagtttcgagaaacacaccgttattgattcagctatttttcctgtattacgcgtttccagtgatcggcattaagtttggtgccgagttgtgtggcattatcggattgatatttctcggcggcagttacatggcagaagggtttaccggcggcttcaacggcgtttccaagggccagttggagtctggtaaggcaatcgggttgagtcgctggcagcttgccagatacattgtcttcccacaaggattctcactgagcgttccggcaatggccgccaatgttatctttttgatcaaggagacttcgatctttacggtgattgccattccggaattgactaacactgcgttggatttaattggcatgtattaccggtccaacgagtatctattggtcttggttgttggctatgcgatcattttaattccactatcaatcattttgactttactagaaaagagggttcgctatggatcattcgggaattagtgttttattcgaaggaactaattttgagcggttactcggcggcctctgggtaacagttaaaattgcggcagtggctttaattgtcggtctcatcttgggaattattctcggcgttttgaggacctttaagaatcggccattgcgagtggttttgagactgtatcttgaattcttcagaattgtgccaaccgtcgtgctgctatttttgttctattacatcttgccacgccaattgaattttaatcttcctggcgatcaattggccaccttggtatttgccttgtgggtggctgctgaaatgagcgatattgctcgcggcgccctaatctcggtgccacagcaccaacgcgaatccgggaaggcaattgggctcaatcgttatcagctctatcgttacgtattgattccccaagcgattagtttggaaattccggcgactatcaatttggccacccgggtaatcaagacgacttctcttttgatgctgatttctgtgatggatgtgattaatattggccaacaaatcattgaagccaataatcacactcatccaaccggcgttttctgggtttacggattgatatttctattctacttcctaatcgattatccactatcctggtgggccaagcgattagagaagaagagattggagcgggcaaatggctgagcagattttacaggttgaacatttagaaaagtattatcaaaagaaacacgtcttacacgatattaattttcatgtcgataagggcgaggtcgtcacgctattaggaccgtcaggatctgggaagagtaccttgattcgctgcctcaatggcctggaggaataccggcaggggacaatcacttttgaggggaagcagattaatacgaccgaaaaaaattggcagcagatccgccaaaaaatcgggatggtctttcagagttacgacctatttccaaatttgaccgtcatggataacatcctactcgggccgaccaaggtgcaaaaacaggacaagttcgctgctaaaaaggaaggtctggagttgttggaacgagtcggtctcgaggattatgccaacgcatatccccggcaactgtccggcggccaaaaacagcgggtggcgattgttcgcgccctggccctgcatcctgattttatgttatttgatgaagtgactgcttcattggatcccgagatggtccggggaattctcaacattatccaagacttggctgatgttgatcacatgaccatgatcgtggtgacccatgagatgaactttgcccagcagattgctgacagggtgattttcctggaagatggccatattttggaacaaacaccttcaaaacagtttttcagcgcaccacaaactaaacgcgcacaagcatttttggatagtatggatttctaatattgaggaggaaaaatttcatgaagaaaagattatttaccagaatcatcgccgttgtaagtgtctttgccgctttattactggtcttaacaggctgcggtaacagtaagaagtcaagttcgcaaagcaataacccaagttccgttcagcagatcaagaaaaacgggaccattagaattgcggttttcggtgacctacctccttacggctgggtcaacagagacggcaagcgtgttggttacgacgtaacattagcccaccaggttgctaaagacctcggagttaaagttaagtttgttcaagtcaatgccaacaaccgagttgatgctttgaactccaacaaagttgatctggttctggccaacttcacggtcaccccagaacggaaacaggttatcgattttgccaaaccatacatgaaagtttccgttggtgtggtttcacctaagaataaggcgatcgccaaggccagccagttgaagggtaagaatgtgattgtgactaagggaacgactgccgaaaattatttcacgtccaagcagcctgatgttaaactgttaaaatttgattctaagacgcagcagtttaacgccttgaagaacggccgtggggttgcccttgccgatgacaactcatacctgtacgcctggtccaaggataacccaagctacacggttggcatcaagagtattgggcctaagtcctacattgctccggctgtgaagaagggcaacaaatcacttctcaactggaccaataaggaaattaataagttgaccaagcagagtttctttgtgaaagattacaatacccaattgaagccttacttcggtaaagaagtgaaaccttcagatattgttctgccagttaaataagctttgattaggcagccaaaaaagcttttggctgctttttctaacattaaaaaataattagagttgacgaaccaatcctaagaagctgtctaaaatctcttaagtaatagtgctaaaaacgctaaaacgaccatttgcagactggtggttaattgacgctcacaatttttccaaagtcgccgacaattctctagccaactaaaagatcgttcgactacccaacgttggggcatgacttcgaatcgatgcaactcattgcgcttcgcaacctgcacggttgcatttaaattactggctacatcgagctgaaaattaacgcctgaataaccaccatcaactaagacattttgaacctggcgtaaatgcatggcatgtaaagcgatcattgcactggccccgtctcgatcagagacgttcgctcgcgtcatgtgaatggcctgcggaaagccattgatatcaactgccagatggcgcttaatccccgagattttcttaccagcgtcgtaacctttgttttcagcagtagcggtgtttttgacgctctgagcgtcaacgataataaagga

SEQ ID NO: 102 - DNA, 3851 bp, Lactobacillus plantarum
caagatattttacgctctcgatttatttggtttgatcgttccaatcgtcgcaatcgttctaatcgctggcttcttcttcatggccaacgtcttggaaacgtctaagccaaaattagactttgcatccttggtactttctaccattggttttgggagcttactatacggcttttcatccgttggtgacaatggctggacgtcaaccgtggttctctcaactttaattattggtgttatcttcatcattggttttatttggcgtcaattgacgatggaaaatccattcctccaattacgggtcttcaagcatgccgagttcacaattgcagctattttgagctcagttgctaacatggccatggtaggggccgaaatggttattccactttacctgcaaattattcatggtttctccgcctttgaatctgggctatcactattagctggtgccctaatgatgggggttatgagtccaattaccggccgggcctttgaccgttttggtgccaaacgcttggcaattttagggatgtttttactgacaatcgggaccattccatttgccttcattactcgtaataccgcaacggtttacatcgtggttctctatgccgttcggatgtttgggattgccatggtcatgatgccggcaactaccgctgggatgaacgcccttcccgttgaactaatgggtcatgggactgccgttaacaacacgacgcgtcaaatcgctagttccattgggactgccatcttgacttccgtcttatcaaacgttacggacgccacaaaaccagctcatagcttgattaagagcaatccacttggttatcagaacagctatttcaacgcaaccttaaatggttaccacgcggctttctgggttgccgtgggcttctcagttgtcgggctcgtcgtcgcgttcttcatgaaaggcaagcagcattccgttaagccagtaatgaacactaaggaggtgaacgactaatgattctcgtactactcgttgttagcgcaatcgcgctcttcttatcatttatctacgttcaccaaaacacattacgaatcagcctatccgttatctttgcggcactcttagtgacctcgatcgtcttcgtctccaagaatgatggtcaacattacgggatggtcaaaacaacgacgaccaccacgcaatcattaaagtctgctggtagtagcaagcaacttgatttattgctctatcaaagtgtgggtaccgctgacaagcaccgggtctatatttataaaaagaccactaatcagaaaaaagttagccatacgacagccagcgtcaagactgctaaccaagttaagacgacgaccgcgacacctaagttagttactaagacgacacggtggacttataagagtaacgccatgaagttctggtttggcttagccaacaatgacaaacagttgatcaagcgaaccaactacttctatatcaataagaactgggtcgtacttagcacaacccaagctaaacaattcagtaaattgatgaagcaacagcaagcgacattaaaagcgcgtgctaaagtctacgtgactaatcaggtcaaggccgcaatggtcaagaacccgacaatgagcaaagcgcaactcgcaaaagttcaaaaagcagcggctgctcaatatcaagccaatgccattcagagcatgcttaaaaccgttaaagctagcaaataacttgaactaacaattaaaaatagctgacaagaccccggcatgccggggtctttgttgtctaaagatcatcatggcttgtccccccctttcactaacgtcttgccaaaactagcgccggcgccccagcgtcaagaccacacttattcaaaatcgatgcgccggttaattatgccggtggtttacaaaaaattcacgtttcttttctgaaaatgtacactatctttactaaaacatgattttgatgctttcgagcaaatgatacgattatcacgtaccaagttgattgttacgatgtcattagaaagtcagacgtctaaaggaatgattacgtgtactatcactcaacatcaggattgttttggatcatcatcgcccttttactttatatgcttagtaaaacagaccctaaaaattttataattaagcaaataagacgatttggttggctgatcaacttggctattctgacttacattatcgtcaggcaaattcagcaccccactggcgtattacaaatcatggtcttaatagtcatcggattttcaacaatgagctcgatttacgctcgctttaaacatcagccttaatcaacgctaagataaaggcttgcccgtgagcaactggtactcagacatgttcggcaacaaactccacgtaagaaaacaagcgtccgcgttgatctaatcaacgcggacgcttgtttttatatcgcccataactgcattattaaaactgtcagacgatctttggtgattttaccgctgaacgactaacaactagccgacgcaaacagccggtcggccactgacggttgaacaggtgccgggttgagtaggctctcggcgtcatcgtagtcatcatcatcgtcatattgatcatcagtatcataatcgtcgtcatcagactcactatcagtatcatcatcgtaatcgtcatcggattgggtttcgctgtcatcggcgtcatcacgattcgaatcttcatcgtcatcatcttctgagtaatccgaatcgctgtcagcatcgctattagtatcggaatcatcgtcggtatcgtcattcgaatccgtatcttgatcactccaatcgtcatcagccgaatccgcgtcggtgtcgttcgtgtcatcattcgaatcagtcgtttgctcatcccgatccgaataatcgtcattatcgtcggcctgatcggcatattcgtcatctaattcttcagcagcatcatccacatcactatcgtcggcaaaaagtgccaaaatgaaccaatcgggcacatcgtctaatgcggccatgttccacttgtttttagcggcagcaatcttccgacgtaacgccgctgctcgtttcgcttcagccgcactaactttcatattcgtcttggccttttttgccgcagtcaataactgttttaccttagccttcaacggtttcaaatatggctttttatcccagttgatggctgcgcaacgtttgagcacgtccgctgaatagttgccgttcttcacctttaactgtgctttaacatcatctgacaattgctgatattcctgataatcactggttacggtgactttcaactgtttcagcttattcgtcaaacttgttgccccgttcgtaatcttgacacccttatcaaccgtcgtcagcgccgttttaacttttccggccttcaactccgatgtggtcgtcaagtaggcctgcgtttgatcccggtacgcctgtgccttttcatccttgggcttctgcgctagcgcgttatcaaaatacgtcagcgctttttggtatttattctcagcaaccgcatttaaccccttctcgattgactgcgaatacgccttgttatggcagccagctaaaccgaccaccatcaaacataacagtatcaataatgatacccggtgcttccccgatttcatccctgcttcactatcctttttggttggtatttatgcttcaataagtataccgttagtccctcaatcctgctagcccatataaattaatttatattccgattgaacatttaaaaaatagtgtccgctccaaaacaccaatcaggactaattatgattaaaccgtgccgattaggtggattcctgttcgtcagccggtgcacgtcctatgtcgacctccggggctgggtga

SEQ ID NO: 103 - DNA, 6985 bp, Lactobacillus plantarum
ttttttgtccgaacagcgtcggattaattttacaatctaccctaattttatatttttgtgaactcttccaaccacttctttttaagttttaggctgtttatctcatgctgaatagcaatcttatcaggcttcttagggtctgacttatcagcaaactcttttaaatagtagtgcttaatcattgcttctgaataactcattttaatttctcctacctttctactattaatagtataacgattccatctaaattttgattattgctagttattttgagcgtctgctagtatatatcttcttcaccgttcgatattcagcacgttcctcatttgttaaaccttctagcgtgctattaattgtgtgttcaagcatctcatccacacttttaaaattaagcactgcggataatgcatttaccatatcggctgtctcaactgagcatctaattgtagtagttttaggcttagactttttagtgtttgctttcactttcatgtcccgcgaaaatatattgctaggtttcggaacttgagtaacatctgagttaaggcttttcttgagcaggtctttactcatctttaccaaccctttcaacaaattcatttgtaattttcttatatagcgcatctactcgcatatcatgcatatcatgtttttgtgtttttaaatctggatcaacaatgccaataatgtcataacgttttagccgttccatatttttaacaacatttttaaaaatattatccttgtcaaactcagcctcggcttgttctagtattgactgatcaacctggctgttgttctttagcagaaccggtagtattcctgcaatgctgaaatttgcgccataattagcgacaagctcttgcaggtaagagataaaggcctcagcacctacatacgaccgttcttgagtttgaagcacaattataacgctgtctgaggccattaacgctgagtcagtgtatacactaacagtcggcggcgtatcaatgataatgtaatcgtagtcatctttaattttatctagcaaatttgaaaagtgtttagctcgcttatattggtcatctgtgttcgggtacttcttttctaagaaaattggatatgatgtaaagtctgcaaaactgggcaacaaataaagattgtcacgaatcttagtaacaatagtacttatatcatcattgctgattgcattcattaaagtattatcaaatttaacaacctcattattttgaacttgtttagtctttagatataatgcggttgcattagcctgcgggtctaaatctgctagtagtaccttgtatccttgtctagctagtctgtatgaaatcatgcagctgttagttgtttttccagttccacctttgaaatttccaaacgtaataacttttaccattctgctagcccccttaatctcactattataattcatatagcacagattatcaaacgtttacatgtagataaatatacaaatatacaaaaatatatgtagactaaaatacaagagtacatgtagatatgtagatatgtagacggtttagctaccataaaagcttgtttaaacagcaataaatgcattctatttcctattatctatttgtatgcgagtatacataaatacatgtagataaatatatatgtagatttgtagactaaattaaaaaagtgttgacgcttgctaaataagacgttacaataagcttgtattaaaaaaggcctagcaacgaagccagacctaaaacaactgcatatacaaaagaagccccgcgacctctaaccttcgtgggaacaacaaataatcatgtattaattgtacggtctaggctctaaaattgcaagtcttgactcaattgcttctcgcggaccattctaggggacaagctagagtataaatattaaggggacacgtttaccggtgcgacttcaataacgaccggttatatcacataaggccttagacaatcaggctggtgatgaatggtgagggcgaccattaacggcccgggtggtaaaacgatgcttctagcatggtgatcactagtagctggtaaccgaacaaaactaaatacgtgctatcagcgtccattagggcgttttttagtggacttaaccgagaatgtaggttgatactagtggttggtagtaataccgcaactgattgtccaaacgatgcccgaacgaccgagcgttacaacaggtgagttgcactctagctagatagtcattttattttgaccgtctgactagggtacaactctgcactcaaccacttcactccctcgcattacagcaggggtaacccaataagtcaactaaattgaataaataaagcaaaatcacaagccagctaactaggtcagtttaaataaatttcacaaaggctaaatcccatcaaaacaggctttaaataacctagcttaaatcagcctaatttcacaaagtaagctaactaggctaaatcaaacagtgagttgttttaaaaggctgatatagtaggtctaagaacgtgtttagaatcttttcaagagtattcgcaggaaggctaagctaatcatcatcttactggtgttcagctttcgctcacaattgcgccagaggcgccgatattttcctagccagctaaaactgcgttcgataacccagcgttgcggggtcacttgaccgtgcctaaggtcactctgtttagcaataatgacttcagcgttaatcattgcctgaactgattgagcaaagttgttaccagtataaccaccatcggccattactcgttgaaccaggtcaaactgtgatttgtttaacgccagtagcgcattggcgccatcacgctcagaaacattggcggttgtcacatggactgccatcggcagcccattgatatctacagcaagatggcgcttaatcccactcacctttttaccaccatcgtagccgctactttcagcaggatcggtattcttgacactttgagcatctagaatgatgaacgatgtataaactgaacgcttctgagccaaccgatgttggctgacaatttttttaaaaccttatccagaggagtgataccagcaggagatggcgttttagtccaaagtaaccagtaataatagacggtttcccatttaggaaaatcactgggtaaatcgcgccaaacgcacccatttttcaaggtataaagcagggcacaaaagatatcatataaatcaacctttcttggcttagtccgcttacgtatgccttctagatctgtccggattagttcaaattgttcacgagagatgtcgctactataatggtgtgcaaagcttttcatggattaaaaactcctgtttttgatctaatttaactaaaatcaaatcgaatgtcaaagtatccaaacacgttcttaaagcagccaaaaccttttctgcttttcaggcactaccactcttccaatagcaatctgctcaccattcagcaaattccgagcgttggttgcaaaacgttcaggatattgggaatccatttcgtttaatacttgataggccttcgtcattgcaaagccccgatttttcagcgtatgcgcatctgatgcgaccacttgaaccaaaccacacttaacgaattcttttgcagttcgctgtacttgttccccaaaagcgccaactaaactcgtggccgtaacctgtgccaagaccccatcctcggccaacttgtataatcgctgcggttcggcaataatttgagcattccgttcagggtgtgcaatgaccggggtaatcccctcacaagacaattgaaaaatcatctcatccaaataacttggtaccatctcgtggggaagttctaacagtaaatagtgtctactggtatctatgcccaacaaatcatcaatattttccatcaactgaccattcagatgtacctcttgaccaggaaaaatggttaacggaatatcatttgcatctagctctgcttgaaataccttaaccgccgctgccacatcaccggcatgattgaggtagtgccgatccatatgatgtggtgtcgctaaaatatagcgaatcccgtcagccaccgcctgccgtgccaattccaatgacgcttctaaggaaggtgaaccatcatcaatggctggtaagatatggcaatgtaagtcaactaaattatttatcttcatcgctgtagtacccgtagccactgttatagccgtagtatccgtgatgagagccatcacgaacatcgttcagcaccgcacccaaaatgttagcttgcgatttctttaatgaattaacagcatcacgaaccgctgctttttgggccacaccttggcgaacaactaagaccgtgccatcaactttattagcaagcaactgtgagtcagtcactggcaaaattggtggtgcgtcaacgatcaccaaatctaatttacgcgttgccgaagtcaaaaattcggtcattttattactacccaatagctcagccggattaggtggcttaggaccactcgtcatcacgaataggttaccaatgacgggatggattgcatcattcacgtcgtccaactgattagctaaccatgagctcaatcccttatgatttttaagcccaaacgttttatgaatcgtcggtcgtcgcaagtcagcatcgaccagtaagacttgcatcccttccttggcatactccactgctaagttgccacttactgttgacttaccttcaccaatcatcgctgaagtcaccattaaagttcgtaacttatggtcagtagccgcaaaattgatattggttcgaattgttttaatctgctcagtaatgaccgacatgggttcattaatcgtcgtgagattaattgggcccgtagtcgttatagtctgttctttacgtttaaacatctaacaccctcctaaactcgtttcatcgcttgtgacgatgttcgatcattatgcgtatgatagccaccattcagattcaaggcctgtttcttcattgaatggtgatgttgatggttaaccaagcctaaactaatcaatcctaattcatcagttaagaaatcagcgtcgcgaacgcgacgatcagtgagcatccgaatcgctgcataaaaaaatcctattaacaatcctgcaactaacccaaccaacatattaagaggtcttttcggtgataccgcaccatttggcgcttcggctggagcaacaatcgtgacgttgttaactttaataatcttttgcacttggttcttaaaactacgagcaatttgattggcaatcgtcgcactagctttcgcattagtatcagtcactgagattgagaaaacttgtgagttagccgtacttgtcacactaacctcactttttagtgtgcttagtgagcgctcaatgccataacgtttgcttaattgttgcttagctggttttaaaaccacttgtccagcaattaattccttgtaggtcgtaaccatctgaatatcagcctgctgcccagcatactcagtagcggcattagtatctttacggttaaccaaaatctggacacttgattggtacttaggtgtaattacaaagaaggtcaaccctgcggcaactattaatcccgccactgtaaaactaacgattgtaagccagtatttacgaacaagccggataaaaaggacaaaatttactgtttgatccatcattcactctccaaaattaacaagattaaaacacgttttaactaacgctattaaatacaatctatcatcaaatataacatcgcattggttgatttacaattgaagtccaagaagcgatctcacctattgactgcaattcaagatttttcatttaccttttgatagctgattaatttgcttcctagatttccaatggcaaacatggattgaagtcaatatttgagacaggttttaagagacattcagaaccgcgtttaccttccacagctcaaataaatcattaatcgtgattaataacttatttgaaccatggaaagcattaaatcaggcggcgtaaaactcggggttcttctcaagcatcgtcttggggcgacaccgatcccgccgctgagcgtgcagataagctgccgtatcagcaaagtaaatcaacgctaccttatgcccgggaattcgctgtagaacggagccacgagtgatctcacgcgaaatagtactacgagagcggttgagttcgcgggcaatccgtgcttgggagaatccctgattgagcagagtttcaatgcgaacgcgatcaaaatttgatagttgttggtaagccttagagatggtacgcttgatgttggtcatgatgtgcctttcttatgtgcttggttgcttataagaataggtcatcatggcctttttggtctatttaattatgtgttgcacttagattgtaaacgcgggtaattttacaatctaccaaataagttgattttttatttttaggccaatagggtatgccttaatggctgtttttgatagcatactatacttggatttatagatgtttattaaaactgtctaaataagaagaccagacattgttttattagtatgaaaataggtgatgaacatggcggaacgtccaatttttgtagaaatatgagcagcaagacgttctctaatttttattggtatcctcatattccacaaaaaatgcatagatcatcaaaaatagggtcacaacttaacagttgtggcctcttttttgatgctgtataattaaagggttagaaccgtgtcattacttaatgacataagtaaggagataaaaagatgaaatatggctatgcgcgggtcagtaccactgatcaaaaattagcaaatcaaattgagttactaaaattggcaggagcagaaaaaatctttcaggaaaagtttaccggcacaactactgaacgaccggagtttcaaaaactgttgcgcgttctaaaaacaggcgatactttgattgtcactaagttggatcggtttgcgcggaacacgcgcgaggccttagccattatc

SEQ ID NO: 104 - DNA, 5101 bp, Lactobacillus plantarum
ggattaaatttgcaatctaccctacgaacaactcgtagtccatcagtttaattttttttagttgttgtgcgccggcggatcacgtgaataatcaacgtcacaataatcgctcccactaccagcaacccaaacaaggtggctggaatctcaatatcaatcgctggaattgaaataaagagcttcacagcaatcaaggcaattaagatgtaggccattggttccaactccggaatcttctgcatgaggcgcataataacttcggcgactccccgcatggccagaatcccaatcagtcccccgattagcacaatgactggattagacgaaatagctaacgatgctaagactgaatccaccgagaaaataatatccatcatttcaatttgaagcacgacggcccaaaacaagggcaaccatcgatgtttcttttctgaagctaacttacgggtatgcttgactcgcgtccgggtaaagaattgaaagaccaagtgcaataggtataatgcaccaatgactttaatttcccagaaatgaatcaaatacgttcccaatccaatgataacaaaccggaaaaagtaagccccccaaataccataaaacaacgacttttcctgctgttcacgagtaggtagtgactgcgtttgcgcagctagaaccacggcattatcaactgacaaaaggcactcaattaagaccaatgaaaagataatcagccaatcgtcgcctgaggtaatcacggtttcccaattatggagatcaaagaaaggtccgtacaattgacccaaaaagtgtaacaatgcttgcttcagctccttcagatattaatttttgctggatttagtgtaccatattccccattaacttgcgattgattctactaattttccgtaagtcagacgtgaggcgactggtaacatttcacaccattttaaaggaagctgatcttttttgtccgaacagcgttcggattaattttacaatctaccaaacttatagctttttagattcttgtcgtctattacccccacagatatatttttggaagccttttactaaaactaccatttacgttgacactgcacaaaggtatctgttataccatgtagatttgtatgatatgaccatttcaatttttgctggtgatcgacgttcagaattatctgaacattttcttcctgttcaaaccattgatttgaattcagcccaaactaaaatgctgaagtcttatgaatatgtagagaatgtgacccattagtcacaaaatgacgaatggaaataactacatagttattgctagtcgtcatttaggatttagtcaacttcatttaaagactagacatcattgaattgacaccttctatgatatctagtctttattattatcgttgttcttgcaaataatagcagtcaagtaggcgcaccctacaaaaccattttctaaacctagtattaatgacatcatagtatcaattctttaaattctgatagttggatggcaactgttataagccgtaatacatagtttctgtatctataattttaatttaagactcgaaaagtatgtctttgtttgttcttcagcatacattgttctgccttgatagtgtgttggtgtttccattgatgttgataaattaattttgacctttgtttaggatgattaatcatttttatctcctattcctcattttagtgttcttcataaataccattatttataaggctttgactactatagaactttgaaagcttttaacttaagagctcacaatatatataaacagccatcgaattatcaatcagatactcattatccttaacatcagttattgaaatatttggtaatactgtattcttactattaatggtcaatacttgcccgagatgcaagccagaatgctgaaaataatgaattgtagcgggtgtttctaaaaaactaataattttaacttctttcccgactggtattgataataaggatagcaaagttgggtgctgatattcggaaaaagattctaactttaaagcacctccaaatgggctcgttttgggataagccatttgttgatttaacttggccattactacagaactatcgatagctgacattagccatgcttgtctaggaacctctggtagtgataattgaatattatccgcgagccaaatctcgcatagacggtaacgatacatcaaatctgcaactagctgatagccccgtttcgttaacttaatctggcctttatttttaacaactaatttttgtgaaattaatcgattaactgcctcagtaactgatccaggcaacacgcctaacattgttgcaagttgcttgttacaggtccatctttgcgtatagctagtctcgtatatagtctttaaataattacttgttcttgatttcattttattcacccacaagcggaataattttaagcgtgcctaaaaaaatgtttaaatattatgacttttattgtacaataacaaaggcttaagtgttagcctatttgtagaaaggtggagatttagttgagcaaggaagaaaaggggagcgtcaaaaagcataagttaatagaatatgctaacggtccttcgctagaagaaattaatggcacaattgaagttcccaaaaatatgggcttttggaaaactttatttgcatattcagggcctggtgcattggtcgccgtgggctacatggatcccggtaattggtcaacttcaatcaccggtgggcaaaatttccagtacctactaatgtctgtcatcttaatgtcaagtttgattgcgatgcttttacaatacatggcagctaaacttggtatcgtgagtcagatggatttggcccaagccattcgtgcccggactagcaagtcattaggggttgtcctatggattttaaccgaattggccattatggctacggatattgccgaagttatcggggccgcaattgccttatatctcctgttcaatattccattggttattgcagttttcgtaactgttttagatgttctagttttgctattattaactaaaattggtttccggaaaatcgaagctattgttgtttgcttaattattgtgatcttagcagttttcgtctatcaagtggctttatcaaatccagattggggcggcgtaattaagggcctcgtccctactggcgatactttttcaggttctaaatcagttgctggtatgacacccttatcaggtgctttaggtatcattggagcaaccgttatgccccataacctgtacttgcattcggccgtatcacaaacacgaaaagttgaccatcatgatgaggaggatattgctcgaacagtcaagttttccgcttgggattcaaacattcaactatccttcgcttttgttgttaactcattgttattaatcatgggggttgctgttttcaagaccggagctgtcaaggatccttcattcttcggattgtatcaagctctatctaatacttctatgttaagtaacggcgttttgattgcagttgctaaatctggggtcttatcggtcctatttgcagtggcattattagcttctgggcaaaactccactatcacgggtactctaacagggcaagtaatcatggaaggctttgtacacatgcgtatgccgctctggttacgtcgtctagtaacccggttaatttcagttattcctgttttgatctgtgttgcccttaccagcggaaaaagtgctattgctgaacatactgccttaaataatttaatgaataactcccaagtattcttggcatttgcccttccattctccatgttgccgttactaatgatgacaaatagtgaggtagaaatgggccaacgttttaaaaactcactatgggtcaaggttttagggtggttctcagttattgcgctaactgttttgaaccttaaaggattaccggactcaattctaggtttcttcggagataatccgtcaacagctgaacagaacctatcttcaattattgccaatattttgattgttggaattttagccttattggcatggaccatttatgatttatatcgcggcaataaacgttacgctgctaagctggcagctcatcaaactgagagtgaggctaaataatgagtacagcttttaagagaatcctagtaggtgtcgatgattctgctgatgctaaattagcttttaagcatgccattaatcaagccattcaagatgaagcagaattagttattgtttctgtcttggaaaaagatgacatgaacgtgtatcaagctttaagtaaaaacttcgttcacggcgagcgaactgagctggaaaagcatatcttagaataccaaaaagaagctcaaaccgctggtgtcaagaatgtacgagccttagtagctgaaggtgaacctggtgaagtcattgtgaaagatattattccacacgtagaaccagatgttttaatcattggctctgaagccaagcggggcattcgacgtcactttggtagtcaagcagcttacatggctaaatattcaccaatttcggtattagttatccgataatgtataaaagccggcgtattattagagtttgtagactctaataatacgccggcttttatacagctaagaaaattttataatgaagactagtaaaatttgcatttcttattaattgttgcatacggtttttaaccgtaactatcaactgctatgaaacacattgtagagactaacatccagcgtataaactgtattattttgataaatatgtttctatttggaaactaagacttataattagcatagagtaactaactctttatcaaaatacccacaaagggcctgctcaactaacaattgagcgggcctcttgtagttcatatcgaaccctatcacaactaatattatatagaaagctagtataatttaatgcctccaatttcaaaatgaatatttctcaagactacttaaaccaagcagtaatctttttagtaagcgattatttaagtattcatgtttaggctaatttaagccatcttaaataaatttagaagctatctttttcaattaacttaaaccgacgctgctgcgtgcgtttactaatcccc

SEQ ID NO: 105 - DNA, 3552 bp, Lactobacillus plantarum
gttttaagacggaccctagtttggattacttggacgtgataatatacctacggtgtctttttagctcggttatgtatccagcatgatttatagctggagaagacgattccgatatctaaaacaggcgaaccggcacatatgccggaaaattcagaggtcacttttaaaattggcggtgtccgtgtttcgaaataagtaactaaatacgacaacttatcgttacttgaatatttttgattagtctgctatcatataaagagtgttatcaaaatatgaataaataaatcggttgacgtaagctcaaggtgttctctttcaggggtgtggaagaggtatctgggtttacgttttttgtatgaggaggtttttgtttggaatttttaggtaccttggtgatcatcttgattgcaactagtctatttggccatctagcctctagggttggtatcccagcagtgatcggtcaattatttgttggaattattcttggccctgcgttgttgaattgggttcacgccaatgattttatccatattttttcagagattggggttatcatcttaatgtttatcgccggacttgagagtgatcttacattgcttaaaaaatatttgcgtcctagcataattgtcgcgttgttaggagttttgattccaatggtactgatctatccagttggtattgtttttggcttgacacaatttgaaagcttgtttttgagcgttatttttgccgcaacgtcggtttcaatttcagttgctgtcatgaaagaactaaatttacttgatagtaagagcggttcaacagtcctcggtgccgcggtggttgacgatgtgctagctgtcgttttacttagcattatggtcagtttaataggtacaaaggctggtacggatacccagataccgctagctctgacttttttagagcagctaatttactttgccgcaatttatttcgtgatgcgttttatcgcccctctcctcgctagactaggcaccaaattattgaatccagtgggacctactataatggcgatgattttgtgttttggtatggcatatattgcaaatctgattggactgagtgcagtaattggggccttttttgcaggaattgcgattgcacaaactcatgtagctcatgaagttgatcaaagtatcgaaccaatcggttatgcgattttcattcctgtattcttcgtttcaattggtttaagtatgtcactagctggcatagaacacgatttgttattaattatcgtattgacaattgtggcaacactgacgaaactattaggagcgggaagtggggctaaatgggccggattcagttcgaatgaagcttacctcgttggtgcagggatggtctcgcgtggggaaatggccttgattatcgctcaaataggctaccaatccaaactaatcagtgatgattactattcggcaattatcactgccattatcctaacaacgttattagcaccattactactcaaacatgcggctcgtcatataaactactaaaacattttagcggtatgacaccccttctctgtgaaaaataactactagatttcatcgagatattacctagtttaattaagtactaaattatataatattggttataatggaggattagttatttgatacagcttgtaaaagaaaaatttgacgttactcgtttgcgatttgttttactcggcctgcttgtgggtttaatgagtggcaccgttgttagcttatttcgctattgtattgagatagggctgcactatagtcgattggtatatagatacttacgaatcgcgccgtttgtttggtgggaatgggcattgttgattggcatcaaccttggtttagcgttaattgtggctcgacttctcaagagagaaccttatatcgctggttctggaattccgcaagttgaaggtcaattggctggtgaattggaaatgcactggtggtcaattctttggcgaaaatttatcggtggtattctggcattgggacctggattatttctcggacgagaaggaccgtcgattcaattaggtgcgtcagttggtcaaggcttcgcttctgggtttaagttatcaggaactgatcgccgactactaattgcatcaggcgccgctgctggattagcagcagcgtttaatgcccccattgctggaactctatttgtcttagaagagatttaccataatttttcaccgctggtttggttaacagcattagccggagcaattggttcaaattttatttcgctgaatgttttcggacttgttcccgtgttacatttaagttattcacgtagtttaccagtatcaaattattggcacttaattttactcggcattgttttgggattatttggttacttatatcaacgggtcttgttagttatgcctaggtggtatcatcaattgacacatttgccacgcccaatacaaggtatcgtaccatttctgctggtaattttagttggttacttttcgccaaatttactcggtggtggtaatggcttaattgttggatttggccagtatgttccacctttgtttgtactaattgcaatttttattatacgattcgtcttttcaatgatttcatatggttccggattacctggcggtattttcttgccgattctttctttaggtgctgtgattggtgcggtttatggcgtcttaatgaatcaattaggattattatcgcatgtctatatcatgaacctaatcattttttccatggccggttactttgctggaatcggaaaagctcccttcacagctatcttgctggtaacagaaatggttggcaatttaacacatttaatgccattagcagtcatatcgttaactgcttaccttgttgttgatttattaggcggtgcaccaatctatgaagcattgcttaagcagatgacaatgcctaaaactgttcagcaacttcatcgacctgatcatttggaaataccggttttctttggcagtcccttaaacggcaaaatggtccgagacatgccatggcctaaagaagcactgctcattggaatccggcgtggcgaacaagaagtgattccacatggtgacaccttgattcatgaaggtgatacgttagtactgttaactgatacaacccaacgaccccaagttaaacaacggattgatgcattattagcaaccttagaaaaaaagcaccaagactaagttaataggtaaattggtttatcataatggtaggtatcagattaagtggatccgttggcagacataaacatattggaaaactatatacaaatacggtgaagtacgaaaaacgctgaaacagaattagttgaacctattttgaaaaatacaaagataaataatatgccgaaaatgccttgctacccaatttttcatagtcatgctataatgtagacagaaaaggaagccttgcgctaacaagacttcctacgcaagccgcttcaaaggcggtggcgaagttaataagacagcattaagctaccctgtaacctaccatgaagtgaacccccgagatt

SEQ ID NO: 106 - DNA, 3350 bp, Lactobacillus plantarum
ttaaatttgcaatctaccatacattgtaaaagtttagccggagcgaccggttgtttttttattttaagacacaccaaagctatctagattaaaaaaacatttgcctttctaccacttcatggtacaacaggccgccaataaagcgggttcttaaaggaacaagcaaataggacgagaagccaagattcggtttctcgtcctatttgcttgtatagcgccagttatatcgcagctcttttaaacttacattttttcaaacacggtcgtactatgcagtggactccgtcgttcgggatacaaggtcatcattaactgattgaccgcgttaggagcttccccgaagccactggcaatcaagcctaacttgcccgcgtaagtcaccgtatcaccaatagccgcaatcccaggtacgtcggtattcatctccgtatcaacggtgatgagtcggtgcgccatggttggggtcacgtgccagtttcggatgactttattatccgcgataaagccgtagttaacaatcaaatcatcaacggccaatgtttcttcagttgtgccgcgaacctctttcatcgtcagctgtaactgtccggtagccgtccctgcaagttgcttaatcaaaaatggcgtcttgatttcaacggaagacgcttttaacaagtccacattgtgttccatcccacggaaccgatcacgccgatgcatgatataaacgtgcttagcaacgggttcaagcatcaaggccatatcgatggctgagtcgccaccacccgcaactagtaccgttcgatccgcaaattgcttgacacttggaatgtggtagaataattgcttattctcaaattcagccgcattatcgactgctaagcgccggggttcaaaagccccactcccagtcgctacgataatcgctttggaatgtgactgctgtccactcgccgtggtaatcgtgaaatcacccatcgctcccgtgacatccgtcaccgggctcgccaattgaatgtcaattggaaattgtgtgagttgcttttcaagttgtgccaccagttcacggcccttgattgccggatatcccgcaacgtcatgaatgatcttctcaggatacaaagcctgaacctgaccccctaattcggggagactttctaataactgaacccgcgcattacgcataccagcatagaaggctgcaaacatgccgaccgggccaccaccaataattgttaaatcatattctgcactcatcgtttcccagctctcttctatgtagacttattgcttctcattctagtggattcggcgaaggtttgcaaaagcaatttttactaattcgactataataggattcaaaggcgaggtggatcagtgatgcgacgaattaaaattattaaaatcatggccattattagtgcgaccctggtcgtagggattggatcctattggcaacatcgcttgaccccattacgaaaaacgcgggtcgcccaaacgagtattccgaccatcttcgtcggtggcgattacgcgcgcgcattttctaccgacggctttgtgcaccgcttaaccgcggcacacctgatgacgaaaggattggtcgtccatgttagtcacgccggccacgtgaccgtccaacagttcggaccactaaaaaacaacccaacgattcaggttatctttgccgataatcatcatgcgaaacgtcaagctcggcagtttgctactgtcatgcaagggctcgcaaaacgctaccacgtgacccgctacaatgctgtcggtcactcatctggaggtaatattatctttgattatctgacagcgcaagtcccccagcgcgcacaaatcaataagtttgtgaccattggctcgacctatccgggcttgaccactcagcagttaaaccggttaccacggtccttgccgatattgaatattgccggccatgtttggcatacaagtggtgatggcggcgtcaatttacaagccgtacttaaattcagccatcaattattggcagctggttggtcaccaaaaacccaaatcattcacggtagtcccctgaccgccagccactcaatgttgcatatcaatccacaggtcgacttactcatcatccagttcttgtacggcaactgatcaattcatcgaggcgtgctgccaatcaacctgaagcacgccacacttctaatttaacaggattcggacacccttacgtcccttggatgggatggcaaatggtgtcttttctggtatcctaaaacatcacatatcagttaataacgcaatcacaaaaaagtctgctaaatctggccgcataccgttagttaagctagcaaacggtgttttgtcagcgatttttatgtacaacggtggtaatgtatgggtatatcttaatggaggcgattaccatgcgcaaaaaatggcgatggttattattagcacttactggaattttctttttgatgttcgggccacccttagttagtcaggcccgcaacgtaattgaagcaacgggcaacgatgttaatagtgcggttatcaaagatagtaagggcaagataatggctcacgatgcacaattgccagaagaccaagaatacacagtcaattacaactggcgcatccctgataacctcaagatcaaggcgggcgacacgatggctttccaagtccccgaaaacgttcgtattccgcatgacgaggcttttccaatgaaaggaaccactgcaggtaccatcggaaccttcttcattgctgccggcgcacatacgggtctcgtcacatttaatcaggcctatcaaaccagaccacgtaatcggaaagggtttgttcaattggacgccttcggaaccgttcctagtcatcctggtaacttagccccaattttattagagaaatcagctgaatgggctgacgaagctaatccacggcggatcaactggacaattcgtgtcttgcctaataacaatcagctcgtcgatcccacctttgttgatacgttgagtccgaaccaaacgtatgtcaatggcagcgccgtcctacgcgatgagacaggtaatattattcccgtcaatacgagcgtgaatggtaatcaattgacgtttaatgccacagggtcgtttacgtcagagttagctttgacctaccaaactaagactaacgaacccactggcgacgcaacttttgaaaataatgtcacctatactgacaagaacagcaacaagggatccgcgacagccacgatttcacggccagtcaccgaaccggacgttcccgaaaatccaggtatttcggaaccaacagatcccgatgaagatgaggaaccaggagttactgaaccggaaaaacctgggactaccgaa

SEQ ID NO: 107 - DNA, 5518 bp, Lactobacillus plantarum
  misc_feature (3160)..(3160): n is a, c, g, or t
  misc_feature (3754)..(3754): n is a, c, g, or t
aggtgtatccttctcgccatcgtcaccacactattgagaaacttgtgctctcaaaactagacaatatcaaatatcttcatatgaaccggaacaccaattacttggttaagtcctcgaccgattagtattagtccgcttcatgcgtcaccgcactgccacttctaacctatctacctgatcatctttcaggggtcttacttccataaaggaatgggaaatctcatctcgaggtgtgtttcacacttagatgctttcagcgtttatcacatccatacgtagctacccagcgatgcgcctggcggcacaactggtacaccagaggtatgtccatcccggtcctctcgtactaaggacaggtcctctcaaatttcctacgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggtaccaccggatcactaagcccgactttcgtccctgctcgacctgtctgtctcgcagtcaagctcccttgtgcctttacactctgcgaatgatttccaaccattctgagggaacctttgggcgcctccgttactttttaggaggcgaccgccccagtcaaactgcccacctgacactgtctcccaccacgattagtggtgcgggttagagtggtcatacagcgagggtagtatcccaccaacgcctccaccgaaactagcgttccggtttctatggctcctacctatcctgtacaagctgtacaaacactcaatatcaagctacagtaaagctccatggggtctttccgtcctgtcgcgggtagtccgcatcttcacggacaatataatttcaccgagtctctcgttgagacagtgcccagatcgttacgcctttcgtgcgggtcggaacttacccgacaaggaatttcgctaccttaggaccgttatagttacggccgccgtttactggggcttcaattctgagcttcgccgaagctaacccatccttttaaccttccagcaccgggcaggcgtcagcccctatacgtcatcttacgattttgcagagacctgtgtttttgataaacagtcgcctgggcctattcactgcggctgatcttgcgatcagcaccccttctcccgaagttacggggtcattttgccgagttccttaacgagagttcactcgctcaccttaggattctctcctcgactacctgtgtcggtttgcggtacgggtagttaagtactcactagaagcttttctcggcagtgtgacatcagacgcttcgctactaaatttcgctccccatcacagcttgtccttaaagtgaaaagcatttgactcttcacaagacttactgcttggacattctaatccaacagaatgcacatcttagcctcctgcgtccctccattgctcaaacgcacttaactagtacaggaatctcaacctgttatccatcgtctacgcctctcggcctcgacttaggtcccgactaaccctgggaggacgagccttccccaggaaaccttagtcattcggtggataggattctcacctatctttcgctactcataccggcattctcacttctaagcgctccacaagtcctcacgatcttgcttcaccgcccttagaacgctctcctatcacgcgacctaatggtcgcatccatggtttcggtagtatgcttagccccggtacattttcggcgcaggatcactcgactagtgagctattacgcactctttaaatggtggctgcttctgagccaacatcctagttgtctatgcaactccacatccttttccacttagcatacatttagggaccttaactgatggtctgggctgttcccctttcgacggtggatcttatcactcatcgtctgactcccggatatgaatcaatggcattcggagtttatctgaattcagtaacccaagacgggcccctagtccaaatagtgctctacctccatgatcctaattccgaggctagccctaaagctatttcggagagaaccagctatctccaagttcgtttggaatttcaccgctatccacacctcatcccagcaattttcaacttacacgggttcggtcctccagtgcgttttaccgcaccttcaacctggacatggataggtcacctggtttcgggtctataacctcgtactcaaagcgcccatttcagactcgctttcgctacggctccgactttttagtcttaaccttgcacgggatcataactcgccggttcattctacaaaaggcacgccatcacgcattaacgcgctctgacttattgtaggcacatggtttcaggaactatttcactcccctcccggggtgcttttcacctttccctcacggtactggttcactatcggtcactaggtagtatttagccttgggagatggtcctcccggattccgacggaatttcacgtgttccgccgtactcaggatcctgaactgagagaatttgatttaatctactgggctatcaccatctatggcggattttcccaaatccttcgactatcaagttctttggtaactcaaatgttcagtcctacaaccccaaagtgcaagcactttggtttgggctgttccccgttcgctcgccgctacttagggaatcgaaatttctttatattcctgctgctaatgagatgtttcagttcacagcgtttacctccaactagactatgaattcatctagtggtaacagttgattaaaactgctgggttgccccattcggaaatctccggatcatagcttacgtacagctccccgaagcatatcggtgttagtcccgtccttcatcggctcctagtgccaaggcattcaccatgcgcccttgttaacttaacctcatttacctaacggtaaatgcgattaatgagtttagcgataattaaacttcaataaaaaactcaaaaaacgcggtgttctcggtttcattatgaaaaaatatatttgatattatctagttttcaaagaacaagtttngaacctgcgaccttcgggttatgagcccgacgagctaccagactgctccatcccgcgataatataatgacccctacgggattcgaacccatgttactgccgtgaaagggcagtgtcttaaaccacttgaccaaggggtcatatttttaaatggtacaacggagaaggagggattcgaaccctcgcaccgcttgcgcgatctatacccttagcaggggcacctcttcagccacttgagtacttctccaaaatgggcctaaatggacttgaaccatcgacctcacgcttatcaggcgtgcgctctaaaccagctgagctataggcccaaaaaaagcgggtaacgagaatcggactcgcgacaacagcttggaaggctgtggttttaccactaaactatacccgcagaatacagatatggcgcgggacggaatcgaaccgccgacacatggagcttcaatccattgctctaccgactgagctaccgagccattgtagccatttagaactattaacttaacggtccgtacgagactcgaactcgtgatctcctgcgtgacaggcaggcgtcctaaaccaactagaccaacggaccaanctctcaaaactaaacaaagtttcgacgcgtgtgtaggtttccgtaatattccttagaaaggaggtgatccagccgcaggttctcctacggctaccttgttacgacttcaccctaatcatctgtcccaccttaggcggctggttcctaaaaggttaccccaccgactttgggtgttacaaactctcatggtgtgacgggcggtgtgtacaaggcccgggaacgtattcaccgcggcatgctgatccgcgattactagcgattccgacttcatgtaggcgagttgcagcctacaatccgaactgagaatggctttaagagattagcttactctcgcgagttcgcaactcgttgtaccatccattgtagcacgtgtgtagcccaggtcataaggggcatgatgatttgacgtcatccccaccttcctccggtttgtcaccggcagtctcaccagagtgcccaacttaatgctggcaactgataataagggttgcgctcgttgcgggacttaacccaacatctcacgacacgagctgacgacaaccatgcaccacctgtatccatgtccccgaagggaacgtctaatctcttagatttgcatagtatgtcaagacctggtaaggttcttcgcgtagcttcgaattaaaccacatgctccaccgcttgtgcgggcccccgtcaattcctttgagtttcagccttgcggccgtactccccaggcggaatgcttaatgcgttagctgcagcactgaagggcggaaaccctccaacacttagcattcatcgtttacggtatggactaccagggtatctaatcctgtttgctacccatactttcgagcctcagcgtcagttacagaccagacagccgccttcgccactggtgttcttccatatatctacgcatttcaccgctacacatggagttccactgtcctcttctgcactcaagtttcccagtttccgatgcacttcttcggttgagccgaaggctttcacatcagacttaaaaaaccgcctgcgctcgctttacgcccaataaatccggacaacgcttgccacctacgtattaccgcggctgctggcacgtagttagccgtggctttctggttaaataccgtcaatacctgaacagttactctcagatatgttcttctttaacaacagagttttacgagccgaaacccttcttcactcacgcggcgttgctccatcagactttcgtccattgtggaagattccctactgctgcctcccgtaggagtttgggccgtgtctcagtcccaatgtggccgattaccctctcaggtcggctacgtatcattgccatggtgagccgttaccccaccatctagctaatacgccgcgggaccatccaaaagtgatagccgaagccatctttcaaactcggaccatgcggtccaagttgttatgcggtattagcatctgtttccaggtgttatcccccgcttctgggcaggtttcccacgtgttactcaccagttcgccactcactcaaatgtaaatcatgatgcaagcaccaatcaataccagagttcgttcgacttgcatgtattaggcacgccgccagcgttcgtcctgagccaggatcaaactctcaaattaatgatgagttctaaaaagctcatttaatgttgtactaaaatttatttgctagcgaattgacttcgcaaatgttttgctcttgattcaaaatcaagagaccctacacatttgattcgtcgaaactttgttcagttttcaaag

SEQ ID NO: 108 - DNA, 3110 bp, Lactobacillus plantarum
tagaacgagtgtttagaaaaagatgtgccatttattgacataggagcataaaaactaagaagaaaatttttataaagctaaaatcaaatcttatgatgatgaattcaaaaaatctttcattggcctttaaagaaaacataaacagtcaagggatgttgaaaatagctaattatttaaaagaattggggaaaaagagcatgaagtattttttgacaagtaatccattgttagctaaagagcaaatactaaatcctagtaacgaatttgtgaataatttacaaaaagatatacctgagagggctaatgcactattcatatgttcggaccctaattcgtatgacttgactgataaatttgcagaagaaatgaagacttgtttctttaactcaggttttaaatttaagaattttaaagtattagataatagaaatgcaaaagaaaaaagtgagttaataagcgaagcagaagttgtcatacttgcaggaggacatgttccaacacaaaatatattttttcaacaaattaatttaaagaatgagttaaaaactgcaaataagattattatcggttttagtgcaggttcaatgaattgctcggaagaagtttatgctcaaccagaactacaaggagaatctttagacccaaactacaagagatttttaaaaggtttgggaataacaaaatcacagattttgcctcattataatttaatcaaaaacgaatatttagatggtaagagactttttgaagaaatcacttatccagatagttttggcagatcatttattacattaaatgatggatgttatttatatggtgatggtcaatatgaaatagtttatggagaaagtttcattatttctgatggaactattaaaaagtaaaaatgtttccaaaagaatcatttaacaaataatattggaaaataaaagaattacctttgtttctgattactcaggtactttttttatatctggaattatataaggccaacagggtataccctattggctagattggtttagtcaaacaaaaatcttaattggttccttataagagcatataattccatcatcactacctgttgtgctataactatggtaaaggtggtgatgatttgcgatttatatttaaggcattaatagtagttgttattatccttgcatttcctttatccatagttcttgtctttaaaaattggtcaacggccattggtactagtacacccatgtcattaaagcttggttggttggagcagtacgaaccgatatacctcttttggagtggagtaattctggcggtactgttaattatttttttgcttatcacacttttttggccacggtcacaatcattatatcttcatcaaaagtctgatggtcaagtgaccgtcagtaagaaagctattgaacattttgcgctttcagcacttcaacatgaaccctttattggcaaccccaaggtatcagctaagttatcacgaaaaaggatcacacttaaaatatcgggtgatctactaaattcagtcaatgccaagaaacagactgcaaattttcttaatcaattaaaaaaagatttgcgtatttgtcttggaatttctgaacagaaaaaaattaaaatcagactcgttgattttaatgagttggacgctaatgtgcaacaatctcgagttgtctaggaggtgataacgtgaccgaactcattaaagcctatttttggccactaattggtggaattatgggattgctcttagcggtccttatcatcacttttggatttttcaagacgctttttgttttgatttttatggcaatcgggattaccgcgggttattatattcaaaaaactggtatcttaacaaatgtttttaaataactgtttgaattataaggaggaaaaattatgcagaatggaacgccaagtgagaaaacaacaactaacgaaaagtctggtgttaaaggcaatttaacatttgatgataaggttattcaaaagatcattggtatcgcactttctgaagtagatggcttattaaccgtagatggcggctttttctcaaatgttgctgaaaaactagttaatacttcagatgtcacatcaggaattgatgtagaggttggaaaaaagcaggttgcagtggatctcgacattgttgctgaatacggcattgatatttctaaactgtatgacaagatcaaaaatgttatcgttcgggaagtaaagaatatgaccgaattagaagtaattgaggtaaatgtgaatgttgttgatgtcaagacaaaggagcaatatgaaaaagattcgacttctctgcaagatcgcgtgagcgatgccacagacaaaacgaaggaagccgtcagtaagggcgcaaagaaatcgaaggaaacattaggtgacagcgttgataaagtaacgtctgacaataaatctagtcgtgttaactaagggagtgagtaaatatgggacttatttggtcattaatcgtcggggcaatcattggtgccattgctggcgcaatcactaaccgtggtgctgctatgggctggattgcaaacatcgtagctggtttaatcggtgcgtggattggccaagggctccttggcacttggggcccttcgttagctggcatggcattgataccatcgatcatcggggcaattattttagttctgattgtttcattagttgttggtcgaaccagtaaaaagtaaggaggaattttatggacgtcttgaaaagtgtatttaagtttatgatcgcttctacgctcattgtaggtggtgtcctcatcggtggcaccgtcttggctgctaagaaagtagatggcattggtgatacattgcaacacaaattacatggataattagccaaatttatctgtattaggcttcttagaacgtaaataattgagcaattgaagatcagttaatcaatatttaaattggtgagataaccctttataaatatagattggaattttttttataattaatcaaagcaggcacttttttacataggtgcttgcttttatttatctatacattatgacctagcagttaaaaactgtttttacagatataaaggtagattgcaaatttaatccgaatttt

SEQ ID NO: 109 - DNA, 3107 bp, Lactobacillus plantarum
aattttacaatctaccttataacaaaaataatatcgcgctggataacatccggtcaaaatattaatcactgataatatcagcaatattcattcccagagcattagccacgcgtgtaccgtagtttttgtcggcctcataaaattgcttgatttcgagttttttgacaccaggcaaagtaacttggcctaacgcatctttgatagtattaattaagcgttcttgctcgggttctgacattaagcgatataggtcgcctgcttgagttgtgtaatcaacttgatagcgataaggctgtgcgcgtgtttcaccacgaacagaatcaggtgaaagtgcggcatccggcacctcttctggcccatgcagtgcattaggctcgtagttgacctcagcaccttgattattaattttcatgtaaccatcacgttcataattatgaactggaacaaccggcttgttcacgggtaaatcttcaaagttggcacctaaccgatatcgctgtgcatctttataggagaataggcgaccttgtagtaatttgtcgggagatggttcgataccaggaacaaaatttgctggcgacatggccgcctcttcaatatcggtaaagttattagtgggattctcatttaaagttagtttgccgactttaattagtggatagtctttgtgggagatgactttagtgacatcaaaaatgtcccatttatagtttagaccttcctcatatggcaagatttggacatacatcgtccatgatgggtaatttttttcttgaattgcatcatataagtcatcttgtaagtaatctaaatcttggctcattgctttttcagctgcttgagcagtcatatttttaacgccttggtctgagatgaagtgatacttaacccaaaactgttcgccattctgattaacccatttaaaagtatgggaaccgtaaccattcatggttcgataggacgcaggaagacctcggtcgcccattaaataagtgacctggtgcaatgattctggagaatgagcccaaaaatcccattgcatattttgcgtacgacggttcgttttaggatcccgtttttgtgaatggatgaagtcaggaaattttaaagggtcgtttacaaaaaagaccggtgtgttgtttccaacgagatcataattgccttgctgagtataaaattttaaggcaaaaccgcgcacgtctcgaacggtgtcaggataacctttttcaccggcaacttgtgagaaccttaagattacgggagttttcttaccgacaccattaaataagtctgccttagtatattcccccatgtcgttttcaagttcaaaaaaaccttttgctccggcccccttagcatgaacgacccgttctggaattcgttcacgatcaaaatgggctagtttttccaaaagattatagtcttgcattaatacgggaccacgagctcctgccgtttgggaatgttcattgttagcccatggttggccggtttccgtcgttaatttttccgtcattttaatcgcccttttcacgtaaattacaagaaagctcttgcacaatttaaacgctaacaccttaacagagtgacttcaatcattatgcacagttaagttaatcgttcatgtggcgtagtttaattttaatcagctatcaagctgtttgatattttctaggccacccggaatcgtcacatgagaaatagtagcgacccatttattaaataatgtgttatatttgtctatcattatcgataattgtaaaatgataattataagaagtaatcatttatgaatcggcttaaatattcgtgtaattctattattgtatttaagcggtttaataagtctaggagggattttatgcattggttatgggttttgatcattggtgctattattggtgcaattgcaggtgctattactaataaaggtaaatcgatggggtggattagtaatattattgccggattggttggatctgcaattggggaagctcttttgggatcatggggaccacaattagccggaatggcaattgttccttcaattattggtggtgtgattgttgttgcgataacctcatttgttctgacacggatggattagtaaggagatgattgcgatgattaaaagcattttaaagttttgtttagctgcaaccttaatcgtaagtggtgttcttattggtgggaccgtacttactgctaagggaattgataacttgggtgataaattacaagataagttacatggataaaaattaattttacaatgagccactgatgggtgtactagttgacctgttagtggcttttagtatgagtaatatcattgagttcaaggaactaaatcaagagcgacgattttaaactaccttcaatcgaataaaagtaatatttacttttattaagaatgagggtatgattaaaatcaaaaaaagaggattggcctatgtctaaacttattgcgaaaaatgtttttcagttgccaaaaatgaatttattagtgctgtctacatcggctttcttattggccttagacgttattttatacaaaattgctatcggaccagcgtattttcaattatcttttggctttttgtctatggcttgtattggttatctatatggtcccatttggggtggtctcttggagatgatctccgatatattaagctttactatttttggttccggcgcgtttcagattgcctttttgttaactgcatttttagggggatttattgacggtttgtttttatatcgtaaatcagtcaattggttatccgttgtgatgacgcaaatacttgtaatgatttttgttagtttgatgatggactcatggctaatttcagtgctatttggcactaattttaaagtgttattgttgggaagattggcacgcgtcatcattcagataccattacaggtgattgctattttttacttcattaaggcgttagaaaaacgacacgtttttgatagaatgaggcttagataatatcgatggatgctacaaaaagaggttgaacacggtatgaaacgcgctacaatcgttaaacaaataagtctaacttttctattgctgaagtgaacccccgagattg

SEQ ID NO: 110 - DNA, 2845 bp, Lactobacillus plantarum
tggtccgcgagaagcaattgaatgtcaagacttgcaattttagagtctagaccttacaattaatacatggttatttgttgttcccgcgaaattaagaggtcgcggggcttcttttgtatattcagttattttaggtctggcttaattgctaggccttttttaatacaaggctattgtaacgcatcaatagctatacgtcaaatccaaataaaaattataaataataaattatttattttaaattacttatttttaattactaattatttgtgctatactgttctcaatggaggcgatagaatgacttgtaaaaccttgctacacttcaatttcaagggtggcgttggtaagaccacccttagtgttatggacacttatctgctaggcgagctaggtcacaaggtacttttaattgatttagatccgcaagctaatgccactgagattatgagaacgacctatgatgtcaaaactgagccaaatgttgatctatttaatggactgttaaagctagacctaactcattcaatcattgaactaactgacaatgtttcaatgattccagctgattggtcgcttagcttatggccgggtaaagttgaaaagattaagaaccatgaccgcatgctaattctcaaaactttgattgaacagtttaaatcacaatttgagtacattattattgatgttccaccgacactttccatttttactaacaacgctattttagctagtgactatgtatcgttagttttgcagacacagaaacaggcttatacgtccgtcctaaaaacagcacagtatatgtatcagctaaaaaacgactatcatgcaacttttgacgtgtcaggtgtcatactgtacctagttaaacgggatgctaaagttgaccgtgaaatcactaaggcagccactgagtcgtttggtgatgcagtattcataaatcgaatttggcaacaggaacgtgtaaagttgttctcaaatgctggtattaaagatgaagactattgggataagaaggccatcagcatgtatacgatggtattaaaagaggaattacacagaattgaggagataaacaatggctgacgactttttaaataagctagcacaacaagctaaccaacaactaggagacaatgaaagcccgtttaaacagaagaaagaggtcactagaccagtacaagttcgtgagagcacgtataagatggttaaagatatagcctatcataaggacgctaaaatcgttgatgtcattgactctatgctgaaatatgctatcaattcagacgagttcagtgagaataataaataatttaaaattaataatttattatttattttaaaaaactagtaaataatcagttttaggtgggatcgttatactattattgtagagataaacaaggaggttaacgcatgaatgaagaagataaaaagtttgaagacttcatccaaggactttatgatactgataaggagccttctgatgaggaatggctagataatattgccagtgcaatggtccctaatgatgccgataaagaaaagagataatgttaagtcttcagaaatttagttaaattagccggtttaagtcggtggtatcatcatgagcaacacgcagataggtcgaacgcccgtaaaaacgctggtcagtcagccttttcgtatgaggaccttaaagggttgcgtaagctggccttttggttatttgtaatcagcatctttatgaattggggctttgttggtgcagttagtttgattgcatgggtagctatgtggtctgttagcctgctattttaaagcaaccttgttaaacaacattattaattgacaattcaatgttatagttataacattaacaataagaaaaaggcccagtgctgaatacactgaacccttaacaagtacccaccgtctaaagaacggtggtcttacgacaacaactgattaactattaaccagctctcatctaaaccttggtcagtttggagagctggttttgtgttaatctttttttactagtgccataatggcgactactgcactgataatatttaccgttgtagaaacggtagctactaccaacattgcaatatccattgtttagcctgttcatcaagatttttcacactctggcattctaccatcccctgttctatagtaggcttaaatcgttcctacagcaaaggtgaaatcgtgccaccactctctaaacttaaggtactgttgctattaaaccacctattcaaaatgtttacaacctaaaaacgcggccttctaaacttccctagcttaaatagggcggtttagggggcttttagtttgccctgcctaaattttttactaggatacccctagaacgtctcgcaggccccctaaatggctctcaggcatactccaggctgtgttaacctgcggctgaataaggggggacatgactaggctgaaacattttgttaaacttccttatatcaaggtgtgtaaggaggtggcaatctaatcaattatattggtgtcagctataaagtgacctcacaggaggctaatacgaacattctagcgtttgccgagtataattatgccatatacccctataacgtctcacaggacgtcttataggggtatatggacatgcacgctaaacgacagctatcaatcaccaataaacttgcaacatcagtttaccgatacaattgcactatagggtcctgttgcgaagtttgaaaatcaaacgcgccctctctgaactccaaatatcttaggccgttattcccattaataccttgatttcagtagacaccgaaaagccgaagagcgttccatttcttggtataccttt

SEQ ID NO: 111 - DNA, 2842 bp, Lactobacillus plantarum
aaatgaatgttaaagctgaagtcaatgtcttgatcagcggggatatgatatggggcttctacgtccgttccccaactatcaataccaccgaccccacgaacggcaccgtagattgataagaccgttcgccgtgctaatggtaattcttccatgtgcgttgcgttttctagttcagcggcggtatagggaaggcagctgaaggcgaatggtgcatcggcttggctaaatgtcaaactgaacggtgtgttgtcatggtcagcgttattttgtgttgttgatcgcgttactgtcacttgttcagtttgcatgtgcatgccgcattcttgtgggaccaagtatggtgtgactggcagactgtcaacgtggaattgcccgtgcgttgcgccggccagccgatcaggataagtctcaccggacaaaccggtatagtcgaagccggtcgcggtagttggcatgataaaccgcagaccaaatgcgggtagctctggcaaatcagactgaccgctataatgggtggcgatattgatctgaccgtctgctgtcaccgtataagtcactgtgacgatggtactaggaacggtcgtggtaacgaagtggtaagccagagagactttcgtggcgatttcgtgatctgtgtatttgttattgagtggcgcgattggtaacggtgtgactggttggtcgtcaaccgtcaattcgatatcttgacaagttgagaacttatcggccgcgtaccactgtgcggatttgactgaaaagccgctaccgtgatcattatcggttgtcgcccgccaaaagatgggcgtgggtgtacgatagagccactctttatcgttgacgacgagtgattcaagtccgccacgttcgtagctaaagaggtagtggaaattagccccctgtagtcctaaactcccgtcgccgtaaataacgtgtagttgattatttgtgtaagccataataatatttcacctcttgcattgctggttttggtgtccggtcggcaaacattaagccgtcaccggagaattcataatcggagtggcgttcgtcgaaatcaccgccataccggagcacgtcttggtcggtgattgggtcatgaacgaagagggcttgatcaataaagtcccaaataaagccaccttgatacattggatacttgtcgatcaaatcattatatgattgcataccgcccagagaattccccatgtcatgcatatattcacaatctaggaaaggtttggttgggttatcttccaagtaagctacaatattttggggcttttcgtacatccgactttcaacatcagaaatgcgatcttttaattctggtgtgtagacaacgccttcgtagtggacgagtcgtgaatcatcgtgttctttataaaaagcctgcatcgccgcgatatcttcgccagcatacgattcattgccaagtgaccaaaaaatgatcgatgggtggtttttaaaccattcgtagtttgaacgggcccggtcgatcacagctgctaaccagtgtggattatcgccaggaacattgtaagaaggttcgatagcccccatcttttgccatgacccgtgcgattcgaggttgttttcggccattaggtagataccggcctcgtcacataattgataccaaggtaattgatcaggataatggcaggtccgatcggcattgatattgttagctaacatggtttggatatcagcgcgcatatcagccatactgataacgcgaccggtgtgggcgttccattcgtgccggttaaccccgttgatcaccaaccgtttattgttgacgtaaatgactttgtcatcgcgcagctcgaccgtccggaacccaaactgatatgggacgacttccaagagttggtgatcagcatcgtaaacttcaattgtcaattgatagagatacggcgtttgtggtgaccacaagtgcagttggtcgaataacatggtatcaaaggttacactgccactaccggtttgcgtttgactcgtcagtactcgcccgtcatggtctttaacggtcagcgctaaagtggctggttcgccggttactttagtagtgatgttgagctcaccacttttgagattggcatttggaactggtcggatgtccaaatcagtaatatggctagcaggctccgccagtatattgacgtcacggaaaataccagagaaacggaacatatcttggtcttcaataaaggcagcagtactgcgtttgtagacccgaaccgctaaaacgttaccttggtcctgaatatacggcgtcaaatcaaattctgaaggggtgaaactatcttcagcgtagccaataaaatggccatttaaccagacgtacagggcttcttctaccccttggaactgaatgataatacgttgccctttaaaagcatcgtcgagatcgaaggttttgaggtacgagccgacggtgttgtccgcagcgtcactgaataggcctggtgttaattgatcttgattgagggtatacggtgggcgacgataaattttaccttcccatgggtatagcgtgttaatgtattgaatttgaccatagccggctagttcaatatgaccgggaacctgaatcgtatcaaagtcggttgcatcgaaatcgggttgataaaaatcaactgggcgttcagccggtgtcttggcgaagttaaaacgccaagcgccattgagactcttgatgaagcgactacccgttttgaattctgctgtgtcgtgataataatggtgatcactatgtgcaggtaattggttgacccggaagacttctgggtcatctaaccattgaagattagcttgcatgaggaagctcctttcaaagtta

SEQ ID NO: 112 - DNA, 3894 bp, Lactobacillus plantarum
ccggccattagctggtaaactaattgggtttaccaagactgatgaccggtgattacaattatcgtttttaaacggtgcgatgcatacttcgttcgatgactaataaaatgacgaaccaaacgactgaaccgatgactgcccaacggttgacttgatcaaagcacaagacgaccgtcaccgcgataaagaaggccaaggtcgcgatgttggaaacagggaacagtggcagtttaaacggattatgcgtactgtcagtggttcgtttgtaaacgtaatggcacaccaacaaggcacaccaaacaatgatgaagttggtcgttgccacgttagagatcaacgtgaagacggtacttggaatcacgtaattcaacgccacgatcaccaataagatcaatgatgagaataacaatgagcgggcgggaacgttgtaacgattgacctttcccatccatttcggcgcgttgtcaccgtgcgcaagtgtaaatagtgttcgactcgtactgaagatggcactattacaagccgagagcgccgcggtcagaaccacgaagttgataatgctggccgcggctttgatcccaacgtcgctgaaaacttgcacaaagggtgactgactggtcgtgatctgatcccaaggataaattgccatgatcacgaataaagcgcccacgtagaagaatgagattcgaatgggtaagctattgatggcccgtggtaattctttttctgggttttccgcttccccagctgtaattccgaccatttcgatgcccgtaaacgcaaagataacgagcgaaaacgacatcaagaagccctggacgcctgttgggaagaagcccccgtgactgaccaaatttgtcaccgagaccgtttgcccaccgacatgggccgatgaaccaatcaagatagcccccgtcacgatcaaagcaatgatagccaccactttaatcatcgaaaaccaatattctagttcgccaaacgcactgacggagagcatattgaatactaataaaatcaaaataattattaagggtgtcacccactgcgggatccacggaaaccagtaacgaatgtagataccactcgcagtcaagtcagccatagctaaactgatccagcagagccaataggtccacccaatggcaaactcgaaacgtttacctaaatatcgattaatgaattctagaaacgaatgtaagcgcgtatccgacaacaatagctcgcccagtgctcgcatcatcaagtaacagaagaaaccgccaatggcataagccaacaagatcgacggccccgcctgtttgattgctgaaccggagcctaaaaagagcccggttccaatcgcgccaccaagcgcaatcatctgcacgtgacggcgttttagtttacgggcaagttgctgattttccatatgacctcaactttcctttaatccaatttgataataattttcataaaaatacagatcattcattttatgataaaataatcggttctgttgcgaagtttgaaaatcaaacgcgccctctctgaactccaaatatcttaggctgttattcccattaatgctcctatgtcaataaatggcgcggaggttattgataaatcttaataaaaagataaagaccgtcaacgatttaatcgattgaaggatccaattggtctgtttaaattctgcgaagcgctaaccgtattgggctaacttttaacggctccggcaaccagaaaactgatatcgagtggtgtcacgtcgttggttagattgccaatcgaaatgaagtcggcgccgcagcccttaaaggtgctgattgattcggcggtgatccctccagatgcttcgaccttaatcgtttttgggacgagctggcgccactgcttgatcgtttcagggttctgattatcaaacatgatgacattggcaccgccagcaacggcttggcgaagttcttcttcggtttccacttcgacctcaactggggtgagggggccgacatgccgtttaacggccgcaagcgcctgggtcaccccacccgctaaggcaatatggttgtcctttaacataatcccgccagttaggtcaaaacggtgattgaagccgccgccaacgctgacggcgtacttatcaaataatcgcaagccgggagcagttttacgagtatccgtaattcgaatggtcgcatcgtccaatagcttgacgaagtgtgtcgtctgggtggcaatcccgctcattcgctgaattaagttaagggtgacccgttcaccagatagtagggtttgggctgtcccggaaactgtgccaatgatgtcgccggccttaaccggagcgccgtccggaattcgtggtttataggttgcgtgacccagtaagtcataagttgcctggggaatttcttgaccgcaaataatgccactctgcttggcgataaatgatccagataggggggttccgcctggcagaaacgcgacactgagatccccgaaacctaaatcttctttcaaaaattcgctgattttttcctttaagacgataggattcattgggtgacctccccgttaggttgctgatcagcgctgggcaatgccaaaacggcaatcgaaccgatcaacagtgaaaccataaaaatgacgaagataatactaatactaatttggtgatccattaagaccccaattaagagggggccaaagattgcgccgatgcggccaattccttgcgccatgccggtcatggttccccgaatattgtgagcatagagttccggcgtcaatgcgataatggccccgtatgcccctaagttaaagaaggaaaggacacagccagaaatcacgatgagaagggctgacgctgattggccaaacatgatggcgccaaaggccgttcccagcatataaatggcaaagacgtacttgacccgaatgcgcttggctaaccacgatgcgcagaggtaccccggtaattgggcaacgacgatgatcgtggtgtaaccaaagctgttcacgataccatagcccttatcaaccatgatacttggtaaccacatgaacataccgtagtaactgaacatcaccataaaccaagcaagccaaagcatcagtgtccagggtttaaaagtggttttcagactaacaagccagtgttgagttccggtgctcttcggtgctgtttcatgaatgtgttttcgtaaaacaattgcaaaaaccccggcgattgcggttaccacaagaattccccgccatcctagaaccggcgttaggagaaatgataaaaatgacgccaccaaccagccgagggcccaaaaactatctgccagaattagcatctgcgaacgtttagtccccctgtaaatgtcggcaatgtaggtggccgcaaccggtaattccccgccaagccccatgccaacgaagaagcgaatgcctaaaaatgtgtaaaaacctggtgagatggccaaaatcaggttgccgattgagaatgtcagcaaggtggcgatcaaggtattcttgcggccaatccgatcggctaagtggccaaagtaaaatccaccacagaccatgccaatggtgctgactgaactaatcaggccggtttgtgaattagatagtgcccattgctgatggacgatgggcataataaatgatagcaacccgacgtccatggcatcaaataaccaagccgtgccaataattaagaagatgaacgtggggcgttgttgcgtgttatccataataaatgcaagctcccttcaattaataaaagtaccaagtacttttaaacgagcaaaataaaagtaggttttactttaaataagagaatacacggattctgtgaaaacatcaagtaaggggtagattgtaaaattaatccgacgctgttcggacaaaaaagatcagcttccctta

SEQ ID NO: 113 - DNA, 2450 bp, Lactobacillus plantarum
acaagattcttgacgctacctcagcgcctatattatataatcagatttcatattcataacaaaagagccctgtcaaataacactgacagaagctctaaataatattaaaaaactagttgtctctcaacaacttattcaattcccgcgactttctaaacgaagccttacacctaatttcaccgtcgagcaacaactctttttctttatagtcaaaacttcgcaaatgatttaaatttaccaacgagctcttatcgcatcggaaaaattgcggatacttttcttcgagcgcatttaaatttcctgggaactcagcaaccttattaatagcatggagttgtacgctgcccggacgcagtttagatgtactcaacaaaatcacatcatctaatgcgagtgaaaagtatcgcgttcctaacttatagttaaaaacatctttgcgctgactattagtcttttttaattcgttctgtactacattgatgtccttaataatcctttgcgtaattaggtcagcagactggtctttcaaaatataatccaacggtgcaatccgccgttccagagttacaaacgatagctcatcgtgtgttgtaatgaaaactattttagccaatggtatcgttgcccgaattcgactggctaattcaagtccagtctgtttgtcctcaccaatttccatatccaaaaagaaaaggccatcttgttgttgattcaaatctgctagaattattttttgatcatccgttgcaaccctaagctccattgcaaactcattaatcataattgtattattgacggtcttacaataattatctctttgctcagcattatcctcgtataaataaattggaaacaatcattcttcctccaaaattgtcaaagttataataactcggtcatttttgctgtcaacatccaggaaaaaattcttttgtctgtctaccaattgttgcacatttgataggccaaagcctcgctgactccctttagtggatgcacctaattcgaacatcttattcacgtcaagtttcttattagttgaatttctcactgaaatttctttcgtttcgtgtagcgagttaaatgcacaagttacctgcttatctggagtagacttggccgcatcaatcgcattatccaataaattaccaacaatccgaacaacatctaccaaattatgcttaattatgaattcactctgatcaagttcgagactcagctcaatccctttagtttgggcatcgaaaaatttctgtacaattaatccccgtaatgtttcattaccaatgtactgaattttagctatcttaccattatctaacgacgtgtcgatagcgctctgcgcaattaattctttaaagtatggtagttgttctgaagaactcccgttagatatggagtcttgcaatgacaacataatattcttgtaatcgtgcttgaaccttcttagctcaagatattgttgttcaacactcttcaaatattcatttaattgtgtattttgtttcgcctggtggctagcttcttgctttttcatatatgaccgaataaaaaaaaccatctgccacaacatcataagcaacatcacaataaatgaagttattaaagttaattgaatggtcgccgtaatattttcatttaagcttattaacataatactttcaatagcaacataaaatattagaaccagctcaaataacgatttacttaaatttaattcctttatcttctgactaacactcgctattttatgagaataccgtctatagaaaaataaaacaacataattaatagcaataacgaatattacatatactattaatagctcatgtgtgtagtactgtacacccatcaggttagagacattatacaatcctctaacactcattcttcctagaaacattgcaatattaccaattaaaacttggataattacaactagtagcaaaatcccacttttatcataatccaacaaatttttttgaataaattgactagcaaaattaatcaataccatgattagaagaataaaatctgcaacaaaaacacttaatactcccaaaagaaatgctaaaaccagtattttcaaaatgcttttccagttaaataaaccagataaaaaatagtaccataacaaaactactagaatagaggtaaatccctgataaaaggtatcaacaacaccaaaatccagcatgcgggacaccacctaatttatcttttttattaaagatttaaaaaagtttgtcagtgttttgcgggaaacattatttccatacattaatgaaatattcttaaactgtccaccacttaccttttgcagctgctcaacatttaaacttttacctactactttatcaaaagacatactatttttagtcataataataccccctccttatctgtaaatttaacatagttataaatagttggtagcgtcaagaatcttg

SEQ ID NO: 114 - DNA, 2364 bp, Lactobacillus plantarum
caaatttgtccaaaaattcggattaaatttgcaatctaccatatgatcaaacattccttagaatgcttaccttgaaagttgggttgagtaattaaaaataatattattttatgttgtgttagcagcagttcttaattttgatcacagcggtgtttgatagatgtttgacggtatgcaaataaaattattgttctgataaaaggaatcaatgattaataatcttgagcgtcatttttcgaatcatggcgtttttatattacaatggtcctagaaaaagtaaagttatggaggcgattaaatgagtgatttggatcagacaaacaactatcgatacgtcattgttggtggcggaatggttgctggctatgccatcaagggaattcgacaggaagatccagagggcgcaatcttagttatttcgcaagaggcggatgttccgtatgaacggccggcactgagtaaaaagctatggctagatgatgagtttactgaagagaacattcggattggtgctgaagattatcctaatgtgacttttaagttcaagacaacggttacggctattaatcggcaagataaggtcattacattgactgatagtgagcaaatcaagtatgaacagctattgctggcaactggcggagaacctcgacaaatccagggacctgctgatccacatgtgctagtctttagacagtggtcagattatcgcaagttacgtaaatttagtggtccgaacaagcgagttgtgatcattggtggtggatatgttggtacagagctcgcatcgtcactgactcaaaatgggactaaagttacgatgatttttccagaaaaagcgctgggcgagggtaaatttcctgagtccattcgggctgagtatgaagcaacgttcaaacgtaatggtgtcacactgatgagtggtcagtttgtccaatcatatcaacgccaaggtgatcatttgactctattgacaaaggatggtacggcgatcgcagccgatacgattattgttgggttaggtgtcacgccgcggattagtttggctgaagatagtagtttggatttagctgatggtggtgtgaaagttgatgagtatctcaatactagtgacccagccatctggtctgctggagatattgcctcttatccagatcacatcttgggtcggcaacggattgagcacgtggaccacgcccgactttctggtgaattagttggccgtaatatggcaggtgctcacatgagctatcaacataccccatacttctattccatgatttttgatatttcctggcaagcaatcggtaatattgatcctaaattgcaattgatttttgatcggcgaacgcatggatcgcttgtttatttcatagatgccggtaagttagttggtgttttagtttggaatgttaaggtgaaccttgatgatgttcgcgcattgcttgcgaacgctccagccacggatgatttggtaggttccattcgagagcaagagggatagtatctggatgagacatttgcgctattgtgaatgtacgtcaggacaaatcgaccatcattaacgatggttcagtaacaaatgaaaagtcagccgtaagttattttgcttacgactggcttttatttttaatgtctaaaattataaggcgctaatgaagcgttgtgcgatttcgagtggccgggtgatggcgcccccgacaacgaccgcgtggcaccctaagtcaaggcaacgtttcatcttctcgggcgtatccaccttaccttcagcgataacagggcgtgatgtggcttggaggacttcctttaagtaggcgaagtcattatcagcaatgttggcaccagtcgtggctggtgtgtagccgtgcatcgtggtcccaataatatcaaaccctaacctatccgctactttgacgttctcgatggtatcagtatcagccatcaagagggtatcagggaattctgttcgcatggtggccacaatctccgccaatttttcaccgttaggacgcggctgacccgtgacatcgcaggcaactacggcacagcccgtagcagcaacggctcgcatctctttgattgttggcgtgatgtaaacaggtgagtcgggatagtcgactttgcttaaaccaatgagcggtagatcaacttcgtcttgaatggcctgaatatcaacaacggaattagcgcgaatacccgcggccccagcttccttagcggcaagggccattcgtgacataataaatgaactatgcagtggttcattaggtaacgcctgacacgagataattaatgatcccttaactgtatttaagaatgtatttttcataaaaaagaccgctttctactagggactgtctgaaa

SEQ ID NO: 115 - DNA, 4162 bp, Lactobacillus plantarum
tttttttagttgcttgtacatctggtttaattcattagcacttaattttttgtttgctcgaatttgcaatccttgaataccattatcatatgtccactgtttaattttagtcatgtcattagtctgataataattggcaattagttcgttccattgatcccacttatctaacggcacattgattaagcctgcaccaccgtcaatcataattttattagcacttaaagtcgccgtccttttgttcccgtcccaaaagatttgttggcgcatattatgatacatgacagtcaatgctttatcagtaatcgtcgttcgtggatcagccaagattttttgtaaaaaggattgttcttgtttttcgttaattaaaggctgttcaaaaaagtcgtcactacctaaatcaactcctcctttcccttgccgtaattctcccggtactatggcgtcttccgctgccacaatcttgttgatttgtttttccatggttaacgttaaaggggaattttgagcagtgatatattgccacccacgctttacgtcaaaacatcttcaacaggtactcctgctacgctcataccgtccataatagtttgtgtttgtggcaaagtggtattaacgccttcaaagcgagcattagtatgcactaacttggtaaaatttgctcgggcaaaccgttggttttctgcagctgtgaatttatacttgtccatatatgttcgtgtcttggccaaattttgtgcctcctttttatttcagtcactgattatttgacctgtccatgttaaatcacaaaatgcttttcgttgataatttgctcttggcgtttatctaagaggtaagtgtgtaacgcgtcaaacagcttgcgtttatcaggatctgggttatgggctgcttgttcccaaatgccttgaatatcaacggcccaggggtcagccagcaattgctctattttttcgacttctttgcttggtttgatcatttaaaaggctcccttcactttcacttagttcagtcatcacctattcagccacttaaggcgcctatttttgtttctaagcgattttaaagcagttttaatataattatgcactgcaacacttaaaacggcttaaatgagctaatatgacgtttaattccaagaacgctcattgtcagtgttctgttcttcggggtgtttagccgcatattttctaaccgcttttttattccaccaaatcccaaataggttttgcatggtgccgtataagtagttctccacgttcttgatatgcttctcattgcttcttagggcgttaaagtagcgtcttaaggctttagtcatcaaaggttttagttcttcgtcgtcaagagggattatgacgccaatatcttgatgatccttttcaactcggtatttagcatttaagataatgccaataaaacgatgcatttgttgcggagttcggcaccagaagctaagtaattgcacggcttctggttctaagaaaaccggtaagccactgtcttcatcagttaagaagtcattagcatggttcaccaaatcctggttttgcttttgaatttctgctggtgagaaattggctgtggaaaagtccaacttttgagtatctatattgtatccattagtatctatgtttttagagtctttatatagattgctttcgattttcgaaattccgctcgtagcaagggattgagagctattgtcaacgaagtcatgcggactttcgatttttttcgaatttctgctggttttctgctggtgagaaattggctgtggaaaagtccaacttttgagtatctatattgtatccattagtatctatgtttttagagtctttatatagattgctttcgattttcgaaattccgctcgtagcaagggatttcggcgtttcttgtccatattcgccccttaaatagacatcagttgctttcacatcgagcttggaaaggtataaacgattcggttcattctttttcgttttaggattaaatcccatttgaatttgttttaatagattggctgtttgtaattcttttttaattttaacggctttttcagtagcgcagttaaataagccctgtaattcttgaacggtaaaaataaagtaaacatgattatcttcatcaacccagtggttgcgcaaagaatactcgagccgatctttcagtaccatataagccaatttagcgtcactgcttaaatgcttgtattgctcgccatacattaataccttagggaactggaaaaataaggctccatatacgttatcggcttcatagtaattgaaatttgttgattttgtcataataaaaactccctttcttgactgacacacgctgtctcaaaagagagttgctaaaacatttgatttgctttaaagtaaaaatctgatatgctctaactgaattacaaggcgttcatttagccttgaggctttgtaatttatcagcatgtgtctgtttgtgagttgcccagtcggcaactttttttaatttctaacaacaaaaatggactaaatagcttcagttagctacttagtccattgactttaatttgtttttaactatccttaacttgtcctttgggactggtttgcggtataattaacctacaaattaagaacaatgttcagtcaatttagaccggcaagttaaaattgactgaatctaagtagctgtcgtgtagctacttgctaaacctaaaatccccgattcctcgtgaatcggggatttttctgtttagcttgatctctttattcgattgttaaattaatcttagtctagcatagcgcttacctacaggcaaccgtatttggttcagtgcactttactagattttacctaaatacaaattagccaaacaaataaattgtgtatttgtttggctaattatttatttaactgctaaattgcatctatgattgaagataagaattctgaacgatttttaaatccgttttttcgggcagccgcatccatttttttaagttgactttcagtaattgagaaggtcactgatcgcttacgctctacttcctttcgactgatatttttcaaaaatgcgactgcatctttcttgttgtctttcaacgtagtctcgtaactttctctcatttcttcgtcttttttatggttgaatgaatctaaactcataatctaactctccttacttggttttatttgctaattcttgaaaaagatgatcggcgtgttctatgaacttttgattttgctttaaaatggattcatcatgattggctaattcaaatattgaagcgtgccttgcagtagctttattaaagagctctctttcaggaattatagtcgcgactgtttcatcgccttctatgtgtttgagcaaatcgcgagacatgcttgtattatgtctaatcatattgccgataaagaaaagctttgcgtctacgtaagtttcgccagttcgataatcaaaaagtgattttctgaatttttcgagtcgtgtttctagatcaaacttagcattgtagccatgttcactgggtgtgatgggactgagaaggtaattactgatagcaatagcatttttagtgatggtgctaaaatctgggtgtgtatcaattaagatatagtcatagtcggttaagcttaatgaatcgaagttgtttttaaaccacatgaacaacatcatttctttgttactgttattttctagataacttcctaaaacatctaggtctataaaaccggcgattaaatctagatttggtccgacactgtcaatttttactttttgagcattatcgtcttctttgaatgcttcagcgatggtattgtttcgtcgtgtcttttcaaaaacggttgttaaattgcactgatggtctaaatcgattaatagaaccttcttaccatttttagctaaccaatcaccataattcaaagtcaaggttgttttaccgacaccacccttgatagcagtaaaagtaacaatcttcatcttgatgcctccttcatctagcttaattatatcattatcaggcaaacaaataaacaatttattaaataattaacgtaacgattttggccggtttaatcatgtacttcggcaatatcaacagcactcattcccggctgataagacttaaactagtctgatatgcttaaggtagattgtaaaatt

SEQ ID NO: 116 - DNA, 2092 bp, Lactobacillus plantarum
ttaattttacaatctaccttacgatctagctgcgctttcccggcagcaagccgatcgtttgctgtatcgacttgagcctgcccctgcgcgagcatggccttggcaacagcgatttgttgttcagccgtagcaatttgggccttcatgcttgcaatccgcgcgggcagggccgcgatttcggccgccaatcgggcgttttcagcggtcaaatcggctaccaatgtcttggcactggctaagtttttagcggcttgcgtggtagttacttgcgccgcagccgtcttcgcgattgctgtcttcaaattacgaacgggcgatagttgttgctgttgcgccattgctaattgcccttgagcttgcgtcaaagcaacattagccgctgtcaaactagttgcagcgacttgaacttgggcctgtttagtcgtaacagtcgcttgtaagccacttgtctggttttgtaaagcttgtaaactggcattttggttagccagcgtggttgctaatgtcttcccggtattttgtaaaccattcaaactagccgttgcagcaatcaacgttgcgttagccgccgcaatcttcttcggatcagcgggggccgtctggacgtaattgaacgtgacagctggtaaggccttagtcccagtagcggcattcgcatgggcattgtcgaacaaatcaacatacttgtcttgctgtgcttccgtcatcccggcattatcgacttcaaatgccgccacgtgtttggccaagttgatggctactccggcatcaccagtcgagtatattaggttgacgcggtgaccaaaggaaccggactcaatgttattggattcatcataccaacccatcacagcattataggccgtttcttgatcgctcatgaaccattgcggataaacttgtgttaaattttctgcataacttgagccagtatgatccaagccaccgtcgtcttgggcagctgctcgcgcaatcgcattattttgcaacgtcgccgtctgtttcaatgctggttgaccattcagcgcccgtagctgattgatatattcaaacatatactgattgattttatccgcattaggcacatacttgccattacttggataggcgacgctgactgtttcggccccagtcaattgagattgtgggaattcggcagcgtcatacttattttgcgattccgtcgtggtcgttggccgttctgctgccgctaaagctgcttgagctgcggtcactttggcttgcgctgtggaaacagcttgattattcgcattaatttgactggtcgtattttgaatcgctgtcttggcagaattgattgcctgggtatttttattaaccgcatcttgcgctgatgctacggccactttagcttgatttgcttgggtggccgctttttgctgggcggcagatgcttggtcaaccgtcgcctgtttagcggcagtgacggcactggctgcatcggcatcagattgggccgtggcctgttcagttttagcttgcgtcaaggccgtgtcagccgcgtccttagccgtttgtgctttcttctcggtagctggctggttggcgatagcgactttgttggccgcaatttgctgttgatcagctggaatttgcgtttcagctgctgccgtttgcgacttagcagcgtcgactttattctcagcctcagcgaggacctgattgttagcatccagtttttgttgtgcacggtcaactcgggctttaccagcatcatactgggactgtccaatcgcaactaattgactttgattagtcacttgcccctgcgcagtcgccactttagcttgtgttgtattgacttggttttgagccgtgactacgttccccttggcagtctgcacgttggcttgatactgttgctgactagtcggtttgaccgttgctaacttttcgttagttgccgtctgagcgctcccctgcgtggcactcgtctgattcgtcgtatcgctgttatcagttgccgtgtcggcctgcgcattgttaacacccaattgggtccccacgaataatgccgcagtggtaatactggtatacaataatttcttattcataaggtagattgtaaaat

SEQ ID NO: 117 - DNA, 2947 bp, Lactobacillus plantarum
aagtatccaaacacgttcttaccacatgcgtaattacatatttctcagacagaaaatcaaattcaccacttgaaggccaaaaaatattcgtttcatcctgagtaagttcagcaacattattaatagactgtgaattacacaatgaaaataatttatttttaagactattactaatttcacacataataatttccccctttatggagtaagagtatatacctaatttaagctagttaacataatgcggctcatcccaagtaaccccctcactccctgataaaacaacgatccgttatttttcctttgtgaaatttgacggtagaggagtggtctagatgaaaaatccccaaaaaatcagtaaactcactttgtgaatttaaccgcctaaactcctagaccattgcgccaatcgtgcctgacaccagtccaaaaaatcccgttctgaaatcgttggtgttcccgtcaataacttttttgtgatgggctcctcacctaaagctgtttcaattaacccaaccactaaataatctgtctgtttcgtaacccaattttgtggtttcgccccaaagactttcgccaaactaaaagcttgatcccgagtcatggtagttagacgtccggtaaaagcaatctcacaatctcttaaatcaagcattttaaatcatcaactttcttgattctaatgttggttttgacttgacaggttatggttttccattcagtttagagggagtgacgttttgagcgcagaattgttccctggaaacagctattgggaataactgaaccagagtgcaattctacgctaaggtttccccctagttcgtcggtcgttaacgcccgtcgcttgtctgtacaattgcggtattgctaccaccactcattataaacctacgttttcggtttagcctactaaaaaacgccctaacaggcgttgatgatacgtatttatgtttgttcgatcaccaactaatcagtggcaccaagcctaagcttcgttttaccacccgcgccgttaatggtcgcgctcaccattcaccacccagccgtacagatagccttgttgtggtatagccagacttattgaagtcgccctggcaaacgtgtccccttggatttagaccccagcttgtcccctagggctttaaaaatcgcaccggccatgatataatagtcattaaacaagttgacttttatgtggcgctcaccgattcccgtcggtgggtgtttttttatgttctattttatgtaaccaatattactcgttgtttggtgataaatcaacatttctttttatgtatccttgtatccttgtatccttgtatattcatatccttgtatctaagtatccttgtatccttgtatctaagtatattaggatacttgcagtcaatcttaatttaacggcttttgagaagaaatgtatccttgtatccttgtatccaagtatctttgtatgttatcatccttgtatccaagtatccttgtatattaggatacttaattggaggtcagtataatgggtgaagtaattacttttggaaattttaaaggtggcaccggtaaaacaacaaatgccacgcttgcatgcctggcactagctcgtgctggtaaaaaaacgctattaattgatttcgatcctcaagcaaacgctacagatatttactttaaaaccgcggctaatttaggccacgatgatattaaatttaatcaaaccttgcttgcatcaatccaagaagaggacttatcaagatcgttggttactttggataaaaacattgactttattccatcaagcgcagatttttcattgtacccacggattatggaaaaaaagtttaaaaataattataaagatagagttacatattttagcaagctacttgcttcactaaaagaaaaatatgattttgtggtatttgatttgccaccgactatttccttaatttctgatagcgccttatacgcttcagattgggttctgattatccttcaaactcaagagcacagtcttcagggtgccgaatcgtttctaaaatatatacaggaacaggtaatcgatgaatacgaagcacctagtttgaatttactcggtatacttcctgtgctattaaagaatggggcgcctgttgatcacagcacattagaagtagcagaagaagaatttgggaaagaaaacatgttaaaaaccctaattcgtaatatggaaagaatcaaaagatattcaatcagaggtgtatttctaaaagatcagttcgataaaaaaataattagattatacgattctgtggcacaagaaattattgaaagggcggactagcatggtggaacttttacacaatcctaactcaaataaaagcaaaataattcctagaaaatcggcgccccagccccaaaaagaaatttccatatcttctctaaacgaatcaaacaaaacgaagtctaaacaaatagatggtgttacttttgatactacgctcagaattgacaatcatctaaaaaactttatgaaagctatggtaattttagggtatagctcaactcaacaaaacggattagcccaattacaaaaaactttttttgaatcgttaactgagtctgaacaaaatacgcttacgactcaaatacagactttggaaaccggcgatgctaacaaagtaaaaagtaaataatcgcgtgctctcagacgacacgttcaccttttagatgtatacttgtccgtttaaattaagcagaatgcacacaaaaaagtcctctattatgcggaatagagggcttttctgaaatcattacatacaggctttgcttaggagcgttgcttgtgtccatttaggacatacacaatcatataacaatcaatgctgtcacttaacttactcaaaaaagccacccacctcgtgatgagatgagtggctttttggtggtgtggtagattgtaaaattaatc

SEQ ID NO: 118 - DNA, 1965 bp, Lactobacillus plantarum
ccatttgacaaacttccaaaaataaaaggtcggcggttggaaataccggctccctttcagtataacctatttatcggcatgcaaagctaatgtgtcaattcgtttaaagaaggcatcatgatccacagtagtcactaaggttacgggccgaccagtcggtgtttcaaatgttcgcccacgaccagggccttcagttaaaacatcactggtgacgcgtttagttgtgacgatttcgggaaactcgctggcaacagtcgttagcacatcccataagaagtaagtagagtttgtctcaaagtgttgtagagcgggcaccaaggcataaccttggccaataaagtcaattgcaggatgctggcgtaatgttgcccagtgctggcgaatggccggggtcaatgggacttgacgagtgctttcaagtccaaccatttggatagtgaggtcactatcccagacagtcttaacggcctgcgggtcccaataagcattccactcagtagtcccgtcttgttcaggttcggcaacattgccacgaccatcaaaggtcccccccatccagtatagttgttcaattttggccgtaattgacgggtctgcctgcaaggctcgtgcgagatcagttaaagggcctgtcatgaccagagtagttttctccgaggtagcctggagcttgtcaacgagatctaaatgtgccggcttgggcgcaacgggcgtaactatggttcccgactcatttagaatcggcagggcatctaagctaaaggcatctagccgccattctttcgggaatgggtgaacgccgcgagagtcagaggcggcgacctctaggtgagtatcgtgaccgaaacgatcgatgactttacgggtagctgctagggctggctctaggtaggaatcggcaccaaccacaccaactccagttaaatggacatctgacatttgtaacagcagtagtagtgatactaaatcgtcgacacttccgtcatgattaaaatacacgttacgcatctgaaatcgctccctttatttacgaacgttatcgttttgatagcatatcatagttcgcataatagcaaaagcaccaatagtttgcaagtaaagtcgatgatggatttagttagggttaaggaagcgcgtgtatactggattctaagttgattaataggaatcaatagagaggatgacggatctatgcaaccagcccgtaaagaacccaaacgctggcgggtctagaatttttggtgttggaaagtatttccattccaagagtactaggccctaatttaaaaagccattgataatggatcaaaaacggccaatagggtataccctattggtcttacttgtctgcacgagctgcttcaatttgcaagagttcaatagcattgtccaaaattatcaatcaactagcaaacagaggaccttaagcaaaactactgaacattgcttaaggccctctgtttgctacgtattatctaagtttatgcattgtttctgccataatccaatgaatgaattttaaattactgatgaagaatataaacattatgactacaacgataatccattcccatagcggagcttttgttaatgtgactaagctgtataagtaaaaaattgttatgggtaattcaataattgcggttatagctccaggaacataagcacgtttattaaagacaaaaactaagtgcatgatcaaatgaaacagatacggtaaaattgcagtggcaactagtaatggtgagcccatgatataggcgactgctgcgagcagtaaataaatacaaaattcttcccagattccagccgctaaaatatctgaacgattcactccaccaaacagcacacgcccgttaattttgggattatgatctttcaaccaatatgggacaaatactaactcttcaaaatcatggaacataaataacaatggcaatatccaatggtagattgtaaaattaa

SEQ ID NO: 119 - DNA, 1903 bp, Lactobacillus plantarum
acaagattcttgacgctacccaataatgtcataattgttctatttttgtacggactatgtggattggtaagcaaccaagtgagtgggcgtatagcaaacatgaaatggaaacgcaatttaaaaaaattttttattcttcaagctattagtatctttcttatattcataagtggaaatttaacatggctaaaaatcagtgccattctcataatggctttaacaatgtctatttctaactcacccatgcaattgtattacatggatattgccaaacaaaattatccccaatcattggttttagcttcttcttttaattcaattttttcaaatgttggagttgctaccggatctgcaattggaggacatgtcgtggccactgtaggcttaagcggtttgggcattgcaggtagtgtctttagtgttttcacaataggtgttctaacaatattaattaagtataactataattaataagatcttttaatgcctgtactgattttggcaattattattcaggttcagtataccagagaataagtcttaatatttatgttagcttcttcatgtgaggatagatagaattttaataaaccatcagcctaaatttttatgcttgtaaaatagcaagctacaagatagtatggtggttttaaaattgactcgataggaaaacaatttattatcataaaacaccacttaacaaaaagattaagtggtatataggagcaattaaataatgaacaatcgtcaattaaggaatatcttgtatattatgaccctaatatttatttgcaatctaccttatgaataaaataaaaagctagtcactaaccaaaaattggtcagtaactagccttttattaattagtatgttttagaaatataagttcagtttaattgcgcaacgggggtttaaaaacgtctatataaaaatcccccgtgttactaacacgaggaataagttactttaacggtaactgtttaaaaatttattttaaaagaggcaaactcatcaagctataggtttgaatgcttatcaatatcaacattataaagctgataggaaggcatcattaaatgctgggatatcctttggttcgcgactggtaattagattaccatcgatcacaacagctttgtcttcaatgcgtgcaccggcataatacaaatcaggttgtacagttaaatatgctgtcattgtacgaccttgcactaacccggtttgaatcattaattgtggaccgtggcaaatacttgctgttaacttattagttgccaaaaagaacttggtaaattcgacaaaacgttggtctgcacgtaattgatctggtgaaaatcctcctgggatgaacaatgcatcaaagtcttgaggactcacttcatcaatggatttatcaatgttaatctgagtaccatgcttaccttcaacagtgcctttttcaaagctgatcgttgtcactttgtgtcctgcagacttaagagcctctacgggttcagtatattcaacgtcttcgactagattagtcaccaaaactgcaactgattttgccataataaaattcccccttgatttatagtatataatatatacctataaataatagaccacaaataatagaccacaataaggcacttttttgtgcctatcataatatttagaaaaatttggtgccgaaaagatttttgttgaaaaaaatcgggcgccacaattgagcaacgtctactttttcaagaagcattaaattttgttcgagaagaagatacgttcatggtagaagcaattgatcgtttgggaagaaattatgatgaggttattcagactgtaaattatctaaagcaaaaaatgtaaaaaggggacaaaaataatggattgaagtcaatatttgagacagattttaagaga

SEQ ID NO: 120 - DNA, 1889 bp, Lactobacillus plantarum
actacatgataatgcgcacttacactccaaataaattggagtaatgctaaaacctgtatcagaagtcagcaagctgacaacaaaaaagggatatgccaacggatttaccgttgatcatatcctgacattctctttaccaaataaaataattttgtttattaaaatcccattttgcgacaacttcttccgcagcttccatttgctctttggtgtaatcttcatcgccaacatgaactaaatcaccattttcaacatcttcaagtttcaaatcttgcttaatttgctttaataatccaccatagctgatttgtcgtgttccagctaaggcatactccaaatttttaatcaccaccaaattacgctcatcatcagccgtcatataatcagctgattttacctcgtatttcgccgtttcttcggcactagcttgcaaagagtcagttcctttgcgtttgttagctttaacagcctgcacatgcaccacaggctcataatcaacttttaaagctctttgccaaagatcggtccattctgcttgcgtaacataattcacgctatccccggtaaaataactagattttacaaacaataaaacatgtaaatgctgattatatgacccatcttgttcattaacggtaatttccgttgaacgtaaataacccaataaatttttagtcacttttttatagcgagttagcttattaaaggctttagtcaaagctcttaaagacacttttaactcctctgctgaatgagcgtttctaacggttaaagttaaaaacaaaaaccgtcctttaggctctcttgcaactgcttccgcaataatttgttttaattggctcgaatttttcatgctctttctccaattgcacaacggacataaccgtttatgacaaaaccaagtttgatacagcttcaaatggttaccaattttccgaaaacgtaaagtttccccacagtttttaatatcatgtgctcgtttaaactctaaaatcgacaaatattccgcatagcgcacattttcaattttgcgttctcgccaaggtcttaccttcccgttttctgtaacatctttaaatacttcagacataaaaagctcctcccgttttatccacgtgaaggagctgaaatatcattttaactaagcttatagccttgacatcatagggttttccccctagaataggctataaatcgtaaatgataatcaactcacgtgttccgagcgaccaaactaggaatttgcacgtgggttttttatttgccttattttattagaatttatacctcaataatacaccaaaaccctgtaatatcaagggataggaacaaaagcactaaaaactagttgttgctaatagtatcaagataagaagaaagcgacaaaaaacgtcgctttcaaaacccaaaaaggcagatcagcaaaaaccgctgaactgtcttttttaaaaccgtggctttcagccacaccgaccagctgagccagctggagcgcaacgcttgccgccgctgggctcgaggaaacaatggcttgtttcctaggacataaggctcttgggttgagtaaagtcagtcaactccttaaagcctcaaaaagggactaactgctaaagcagtaagtccctttaattcgatttaccgttgacagacagttagatagctcactgttagctaaaatcgcttagaacgcaaataagagcctttaaaattaacgttcaaaaataaaaaagttcgaaggagctagcgactgaacttatttatttttgaatgttccaaactgacgcaagtcagttacgtttgagcaacgcgaaatctgatgcaggttttgatgggtttagcacaacacaacttcatgttgtgtataagtgcgcactacatgataatgcgca

SEQ ID NO: 121 - DNA, 1779 bp, Lactobacillus plantarum
cccacgctttaaattaacaataatttgcttacgcaataataaacttacactgtgaggaactaaaacaaaacgtgaatctctgtaagtcaactggcacaagggatatagagtttttttattgaaagaattttggataaagaagtagtgatatatactctttctttatccaaaattcttttcaattttaatcgtcaaatcgcttgtgggagtaggagttacaagttttacagtttgtattagcgacttattaacatgtgacgttatgctaacagttcgaacgttagtgagttactgtgagttagcgttttaacgcttacccatatatataatattatgtattatgttagtgtcgtgatacttgcgcaagcaagttgttgtcacgaaatgaacgtagtgaatgagttgctcttcgtttcccttggagcttacaagggaaaacaacggagcgcttagcgtaggcgttagtatattaacaaaggtaattcacaaactttttatccacataaacacttatatatcaacatttcaaagccactaactagcgggataaatattttatgacaagtaatttatatccatttttattcacacaaacgcttatataccaacgttatcaaggctattcacaagggataaatatgactaaacagtgtccagcactcacgttcaacatcaaacacacataacccacacacattatcattcgtcacaggactgttaaaacgacttataagcaactttaagtcatacctggtatatttatgccacaacgtgctaaagttgcttatatcgaattttataaggctatttaatgacgtagaatgacgtgcgtgcatatgatctatttacgggacttctaagccactctaattattaatcatgtaattatacctgttaacgtataaagttgcttaggttgcttgttagcacacaaaaaggcctatcaaattaatgacggcctctccgtgtgtaatttaaatgaaagtagcatgtcaatttcttaccacacaagtagtatatcattgtaaaaacatgttgcaataataaaataaaaaagtctatccaattgaaggtaggcctttttactatactttatagagagtcaatccgcgtcaactcagatcaactatgtcacaaagacgactatgctacaacatgaaaataaaaggagtgtccacattaagaacacacgagcattatatcatgacagcaagccattgcaaatagttatataaaggctatcactagtcaacattgaacaaaacgctactcttttcattattaacttgaatatccatatcaatttcaaatgatagtttaatatattcatctttatttgttgctctatttttagatgtattaaatctaaaaatacgaaaagcatttcttgcatcttctgaaagaataaaatctatattatcgctgaaaggaagtacctttgctctaagccccttataggtgaataacgtaccctctatatgactaaattctttagggttctgtgctatctttccctctgcaccagacgttaataacaaggtttccgataaaaggcttttgttattgaacggttgaggatcaccagctaactcaaaaatagtataaacacaataagaaaaaacacatttttgaacttcatttattatcgtattaaacatagaatcatcgacattatcaattgaaccaccaaaaaatccgtaatttatcaggatagaaaactttttattttgcagatgaaattttttaacaggaagtttgtcagaacgtgtttagaatctt

SEQ ID NO: 122 - DNA, 1768 bp, Lactobacillus plantarum
gttttcagacagtccctagttgccgttaatttagtctacttaaatggactagtgattaccaagccaatcatgatttcccaccgcggcgtcgataacggaaacggcgtgcaaaacacaattcctgcactgatcaagaccagcaaggaacatccggattacgttgagatggacatccaagtcaccaaggaccatcaattcgttgtcatgcatgatccaaccttaaaagccttagctggcgttaagaaaaagccatctcaattaacattaaaacaactagaaaaaattactgttcgtgaaaatggctatcaggcaaagattccaagtttcgatgcttacctgaaagcggctcacaagcatcatcaaaaactattagtcgaaatcaagaccagctcggcttacaccgccgccgatactaaacggttcatcgatcgttatggtgtgaccctactggctcatcatgaccaagtccatacgcttagtttcaaagtcatgcgtgacttgaaacgcttagatcaaaaacaattcgttagttacatcttgccttataatctcacgttcccgcatacagtcgcgaacggctacaccatggaggtcaccacattaaacgaccaattcgttgacaaggctgaccgcaatcacaagacggtttacgcctgggacattgataatacggaccaaatggatcaaatgatgttcatgggcgtcaccggcgtagtcactgataatctaacggaaatgcagcaagaagttaagagcaacaccgaccatcccagctatgccaaactcttattgacttttatgaatgaattaagtctaactagcaacgagtaatccacattatttcaaaattgctgtcacagcgagtgcataaatcattcagcaaccacgaaaattctgaatgatgtcgttgctgaaaaagtgacttccagctgatgacgaatcgtaagcgccatctgaatgcataagtgcatttggatagcgctttttttgatctgattagccgtcgcggtgattgagatgttggtaaaaaactgtattaaagtgcgcagcgctccgggttatctgccattttaatttctaaagcgcacgaatgccgatagttgatcagccactgatttttaatacttttaccgccaattaggtgatcatatggaatgacccagaaacagggtctgaaccatgaagtcctttgatgacagtacgttatcagggacgtcaatattagataaaaaccagaaagagccatgagttatcatgactccgtaagcaacagattggtagcagttcgtcctacttttgcttgtgtctcaacacaacaaccgaaatacccaaaattccaagaactattggaacatcgattgcggtaaccggcaatccaaattgcgataaaatgtaaatgaagcatactattaataaaacaccaccgtattttttaaaaaaaccgataattacattgtctggataacgcttttttaaatacagtaatagaaaaataaaacacaaataaagtatcgtatgcttcacaacacttagtgacatataaaatctaatcatctaaactaacacaccatcaataatggaaccttttgccataaacagaatcatcctctcaaattctacgttaacaacaggcagtatgttacgaatttatcttaacaacagcgtttctttatcgttatcaattttcagtaaattttgtgtatttttttgtacaaacttatacggtagattgtaaaattaatccgaagccggatttaaaattgaagtg

SEQ ID NO: 123 - DNA, 1688 bp, Lactobacillus plantarum
tagcattgttaaagcgtcacaggaacatggttttgatccgatgaaagaacggattgaaacggttaagtgggacggccagccaagagcggaaacctttttcattgattaccttggtgccgaggataatcactatacacggatggtaactcgcaagtggttagccggagcgattgcacgggtttatattcccggtgtgaagtttgatattattccaatattagagggtgcacaaggacttggcaagagtaccttggtgcgtcagttggcacccgattactttagcgatgacatgaagagcatgaaagacaaagacgactatcaaaagctaatgggtagttggattattgaacttgctgaactgtcagccatgaataagactgatattgagagcattaagaactttacgagtgcgcaatcggactattaccgtaacacttatgcgcgccggccagaacagcatccgcgccggaatgtctttatcgggtcaaccaaccatcgagactatttaaaagacgctactggtgaacggcgcttttatccaattaaatgtggggtgcagcccgttaccaagaacccactaaaggcgaagcaagctgatatgttacaaatccttgccgaagctaagacttggcttgatgctggcgaacagctttattttgaccagcagacgcttaatgaggccaaagcctatcaacaagaagcccaagtcattgatccaatgcgtgaggctgtgaatgattatctgacaatgatggtgccgactaattgggaagaattaacgattagtgttaaacagtcatatttcacggctattgagaatggtaatccgattgattcggattcagaaagctggctacatgcaaaactagcaccgactaaagagccaattcagcgcacgactacccgagaaatcatggctgttgtttttgaccatgcgactaacaagtattttagtggtaggactaacgccgaagctaagaagattaagctaattatggacaatacagagggctgggaatataaacgagtacacattagagaacgctatttacggatgtatgttaggtgttaaatagaagtttattactaaataacgtggttcaagtggttcaaagtgatataaagctatatatatcaagcgatacaaagatttactaacgtggttcatacgtggttcaacgtggtgctatcatggttcaaatgaaccacgttgaccacgtatgaaccaacagcaaagcaataacaaacgttgctataccggcatttgaaccaatgaaccacgtttaccacgttaaaacgatattaaactttaaagaattgcatttaagatgaaacgggaaaaggtaggtgccattaaaatgacattatcaatgaatgagtttaaagtgttgaacatgttgcctcgtggtgcaggttacccaatgacaacgccgaatatctgcaaggtaaccgggcttaaagagcgcgatgtcagagaagccatcagcatcttaattaatcaacatggcgtgccaattgttgctaaccgaagcggtcataatacggggatgtttattgcaacggatgaagccgagttgaatatcggggttacttcgtttaagaaccaagttactacgatgaacgcccgtattagagccatagaacgagctgacttgaatggctgggaacaagccctaagaccagagata

SEQ ID NO: 124 - DNA, 1658 bp, Lactobacillus plantarum
aatcttattcatcgcttcttgtggtgtcttagttccccacaattcattgaacgtattcatattaaagggcaaattgtacattttacccttataatttgcgactggactattcgtatagcgattaaacgtcgcaaattgattcacatagtcccaaatctgtttatctgacgtatgaaaaatatgagcaccatactggtgtacctgaatgccatcaacttcatgcgtatatatatttcctgcgatatggtcgcgcttttcaataactttaattttcttaccacgtagagccgcctcatgcgcaaaaactgctccgaacaggccagcacctactactaagtaatcatatgctttcaaaagtattctcctccactattaacccttgatttatatagtgctcagcttacgaagaaaaaataagccactgcactgaaaaagtttattaccaataccaagcccccctatactaaaattttaaaaaacatcattttaataagcttatgatatagttacgttcttattataaaaatggagaggcggggccttgatctaggggtattaaaaaattttatttaattcatactctattctactaatcaattctttcgtataatatccttcacgcaatctatgttgttgtatgcggatattatcctgtaattgctcatattgagattttgagatggctataatagtactatcaagttcttccaaaatgcctaatgtcaacccacagttattattctttaaccatgtgccaacattagaattagtgtctgctataggaataattcctgaagctaaataaagacttaacttatattgccaattatatttttcatacgttttaaatgttgtattaccggtcccatctgaatcccataacaacccataaccagtgtttaattttgaaataagtttatcattatcaaactgccccatatattcaagattttttggaagagtaaaatctaagttactgccaaagatgtgcatatatacatctttgatatttcctaaaaatccagccttagtaaaggaaatattaccagcataattgacagtatgtgaaaaagtaggataatttattggtgtattagtcagaaaatcaaatggatccttttgaataactacaggcaccttcaatccagcattggtcagtacctctcttgctaatttactaggaagagttatgacatcaaattgatttaataattctatatccttttctaaagtattatctagcccccttagactgtttatgtcatgtactatggctataacagcgcactgtttcatgtgtgcttttcttattaagtcgatttgaaaatcagatgtaatataaagcggatactgaaaataaattacagaatttggttctacagcatctattaccttattgttaatatcaggaaactccgttaattgagaattgtacataggataattaattttctcaaataataatttagatgtcagaatatcactgatatcacgacgtggttttattgaaccatcatatgaattgcgtaattttggtgttaaaatatacttttccataaatatttctcctacattattgaagtcgaaagagagataaactaatctttatattcaagttaaacatataaaaataaaaggtggtagcgtcaagaatcttg

SEQ ID NO: 125 - DNA, 1625 bp, Lactobacillus plantarum
taattttacaatctaccataagcgtaatttgccatcgtttcaccatcacctttgtagccatgggaaacaataacggttcggttgctggttgttttagcaggaacgtactgtgcgacaaggtgattggcctcgtcattagcgttcagttgccactgttgaacgggctgtcggtgtagccaatcgacataagcgtagtaggcatcggcgtatttttgtttatctgccgaagtttcgggcacgtaatcaacacgcttgaaagcaaaatcgtagagcttctcactcgcgaatagggcggccgaaaaaattgccacaggagcactaattccggctacggcgcgtgtttttttcattaaatatcactcctctaatctctcaataatatgatacgccgattagaagtgagatgtaactatattattctagtaatataaaaggccatcgcggcgggcgatgacctataaattgcattggtcgctaggtggcatccccagcgagcctgtttttcattaactttggaggagtaaatgaaaaaggttcaagtggctgaaggagatgtccagtcactatatgtttagtatagtagtttgattgttaaaaggtaactaaatcgcttacttgactggtgaaaaaactaaaaattatttgtgggtggtcgatattccggtatggacagatttcgtcgtgccaagtatgataccgattcaagtcgcattaagcctccttaagggctagttcatgcactttagtgctaacttgattaaggacctgtgttttacgttcatctgtcaaaaagatgcgctgacttaaaattgggtagtgttgttcacgtgcgattagcaataattcacgataaagcaaagtggcggctaatagcgatggccgggcgacgggatcaatttgtggcatcatggttaatgcagcctcgtacttgttcatggcaatctgtgcttcatgttcccaaagccgaataaaattggcagatgggatggggccatgcaagtcagttggattgagctgatagtgtgccaatagttttgatggcaggtagattcggccacgttggtagtcttcaccaacatctcttaaaatattggtgagttgcatggcgatgcctaattctacggctggtttgacaagtgattgcgggttagttgctagcattggcaaaatcatcagaccaactgatccggcgacgtaatagcaatagtcttcaagtgcttgctgagtttgaggttgtttaaaagtcgcgtcttgttcttgaccagtgagcatatcgaaaaagacgtcaagattcatatcataagtctcaaaaacaacggccagtgcgcgccacattgggtggtctgggacatgaccattggcaaaggcggtcaatgattggcgtaatgccattagaccatcaatatcatggtcaacatcaacgaggtcgtcggctgttcgacaaaaagcataaacggcgtaaatactccaagcgcgttctagtggtaattgcgagaaggcggtgtagaatgcgctagaggaccttttagtaattgcttgacagtacgcaaagtcagtacgatgttgttcgaatttaggcattagtttggtcatctttaatcaaccccaaattgcaagaacaaatt

SEQ ID NO: 126 - DNA, 1555 bp, Lactobacillus plantarum
aaatttgcaatctaccatttggttagtttgatccatgagttttgccatcgtttcgtgaccatttatttcaccccgcttttatcgtcaaaaaaaccgtccttatccagccaatgctgtgttaaggacggtttgataaccgcggtgccaccttaattgagtgttcgccaatttagtgattaaatcacgcgtacactcctactccataggaaactaacatttccctgacaactgacgtatgtcgcacgtctttccgtactctcaactgacgttaatttcggcaaagccctcggtggtccatttaattacctgcgttcggccatactctcagcaacgatgactctctgtgcgggcacgataatcttgatctccacctcattggtttataaggacgatattttgttgaagtgagtataccgcttttgaaaatcagttgtcaagagctggaaaaatattgttcaactataaatttagtcaaacagaaaacgatgttcgtaaataaaccgaggattaatatagtgtcgcgtggcattgattgcgtggcttttaataacggctgcaagcattaattactttcattatgcgcgaataaaaattataatgacatcaataatgtaaacggattcaatattgcggtgacaagattaaggagggctaaacatgagctttagagttgtagccggttatttcggtgaatttagtgatgaagcgaagcgggccaatcaagacttaggtgtaatcggcatgtcgtttcagtatcaatgtaatctcgtttatccagaaggggcggggccaaactttggttttcgaaccgacgcgcaagcgattgatgtgttcgatgcgttaaaagttggttacgatggtttcaaagtgcaagctggcctgattaaggcgatgggactagttgattatcaattggttggtggtcgttacgaactagtcggccatgatttccgagaattacctttagctgagatcaatgcgaacttggaaacgatgcccggactcttggctcagggaccgatgccagttcgatatgtgacttatcgtcggacggatgaccctattgacgcggttggctttagtggcaactggacactaggagatagcggtggctttcgacagttaagtgagacgttggcagaaccaatgcaagcaccagtggcggcgctaattaaggcaattgatcaacttggtttaacgttacaacaaattaatctacccacaccgcaaagttcaacggctttgccgacacatttgagtgatgatgttcatcaagcgaacgttgacgtgtgggtggtgttaacacagccacaaggtgacgagcagcaagttttgcagaccattcataacgctcaagagtgtaatgaaaaattgtgcgaagcgctgactcgtgtttatttgaagtaggatgtttcacgtgaaacaactggcacttggcagtccgttattttctttagtgcgttgtatgatatgatacgcacgaaccgtaacacatcttcacgggagaaaatatgttattagaaacttatcagcatcccgaattgtcaaatcaagt

SEQ ID NO: 127 - DNA, 1448 bp, Lactobacillus plantarum
attaattttacaatctaccctttgattaataaatatcagaaaaggagaagttaaattcatggatattccaacccgtcgacagcaatttaaagctcttgttcaagcacaatcgactgtcatttcggcgctaccttacttattaggttgtgccttcacctatttttattacgatcactttaatattggcgatgctgctcgcctctttattgcggtcatctgtttccaccttgccgttaacggtcacaaccaatataccgattacaggaggttcaatgccagcggctcagtttcggagaataacattattgccaaatttaaaatcagcctttcttgggcccgattaattattggcagtctcgttctcctttcagcagtaattgggatctatctgacatttaagactggctggccgctacttttgattggtctcttaagttttttgattgggtacgcctactctggtggccctcacccgattcttaagacccctttaggtgaaccagcttccgggatcacaatgggctacaacattaccctactcgccatctacgtcaatatttataacagtcctcaatttgaccccttcttctggctaaagggcctcattgttgctctgccagcaattcttgtaattagcaacgtcatgcttggaaataatatttgtgaccgggacgaagatattcaaatcggcaagcacactcttgtctactatatcggtcgttccgcagccatgaaggttttaatcgcttgttacgttctaagttatattatgatcatcgttgcggtagtccttcactacttacctgtgctgaccctgctaagtcttgttaccatccccatcgtttaccaacgaattaaagtttttgtccaacatcccgataaaatgacgacattctttaatattctgatcggccttcaattaattctggttagtgaaattctctttacgattattggcatcattatcaaagtcatataagacagttaaaggacccctggtaaaagcctcaactgacttctattagaaactgtttgaggtctttgaaagacgcttgaatttccggtaaaatatgtgaaaaaaggacttcattatgactgattatccaagcaatatcactcgtgaccaatttgaattgattcgcgttgaccttgagacgttttgcaagcgtacatgtcctcgaagggtggacctatttgatgtcttcaatgcagtgctttacgagcttcgtacgggcgctcaatggcgtcagttgccgcatgattttccgaaatggcaaaccgtttacacttactttgccatgtggtcaaaaccattagctaattcggaatattccctgattgacctgcttttaaaaaaaattgtcgctcgagagcgattacgaatgggacgatcggtacgaacgtcgttcgtaattcttgatgcgcaaagcgtcaacgataataaagga

SEQ ID NO: 128 - DNA, 1356 bp, Lactobacillus plantarum
gtcaagccaatttagattatgataatttatctaatgacaatatcaagtccttatccaaaaaagtatccgagtttttaaaggaaaagtccgtagatcattagtcataggaaatggggaattccatgcctaatcaatatgaaaaactaattgaacaacaagcgcgtttaaaacaaaaaattgagcgggaagattttaaattacggcaatctaaatactacgaaaatcggcaagcccgcaaagcccgttctcgccgattaattcaaaaaggggctttgctagaaaaatactttcaagctgataatctctcggttgaacaaaccgaagagcttttaaaaatatttgccgactatgttaacacccataaaccgaataaattcaaaaacgatcaacctaataactaggccgatcgtttttattttcaggattattttttggcttaacttctagattgtttttagcaaagtctttgaactgtttttgaattctttgtgtaagctctgctttattttctttgtgcttccttttacttgatcgctgttgaattatcttttgatccttacctcttctttttgattttagggcaagcgtaaaatctgaaattttattttgatctagcttacttaaatgaccgatttctttaaagtttaaaccggctttgggaaagcgataaatattaccaagatcgacccaggaaggtttcttcaacccagcggattgccaatcttgaatcggataatattgttgcttgatataagccgacttcttttcatactgactagtaattttaaaagcctcgaccgtctgttctgatacccgacgaattaaaactggccgagacttgccaccgttagtttctacaaaactaacgtataggctgactaagtcattagtcctcatctggatcattgagccaatcagcgacttctttggcgtctttgaactctgttactggtgtcccttcggtcgcctttaaaaagcgtaaattagctttttcttcttcgcttaaagacgcattaaaaggtaaagcaccattagcaacaatccgcttgtaaaacatgttaatggccgtggttggatttaagcccaattcgcttaaaactgcttcggtatcatcggccaaatctttatcaatcttgacttggacccgtttcttttccttaactgccatgattgtctcatcccctttcttttgctactatcattatactaccttttaagtaccttatcaatagataaagccctggcctcaaatcacttgagcttggcgttgagctaaagactgaacttttgagctggttagctctggcactcatttaaaagcccctattcttctgtttaagaacgtgtttagaatct

SEQ ID NO: 129 - DNA, 1299 bp, Lactobacillus plantarum
acttcaacacagacgactcaacaaacgaccacgacacaatcatcagctcagactagtcaaactcaagctcaaccgagccaagctagccagacccaatcaagtcaaacacaaactagcaaacctgctgctcagacgatgactcaaacgtctagttcaacatcaaactatagcaacaatggttctgatagtgctgctaaggcttggattgctggtaaagaatctggtggttcatattctgctcgtaacggtcaatacatcggtaaataccaattaagtgcttcatacttaaacggtgactactccgctgccaaccaagaacgtgttgctaacagttatgttgcttcacgttatggttcatggagcaacgccaagagtcactggcttgctaatggctggtactaaaaagccactttaaattaataaataaatgcaaagattgcggatcatttctgattcgcaatctttttttgggtctagaatttttggtgttggaaagtatttccattccaaaagtactaggccctttttgataacaaaaaaaggcatctaagcctccctagtgctatgctttaagcgacgaaactcaagataagcggggtaggaatagatgtctcaactagataatacacttaaattactgggaattacagacacaaacattcaggtgttcggtactcgtgaggaatttcatggtcggggctcgggtcgcaaaaagtatttggtcatccaggcagagcttacctacacactcaggcgctgtcccagctgtggatacaatacgttgcaccctaacggacacaagctcactcatatccaccttgcaggacccatggaccggcccgtaattctagagctaaacaagcaacgctggcgttgtagtaactgccatagcacttgtatggccaccactccagtggtatcaaccaactccgccatcggtcacgggctagcgactcatgtgctgaagctagccagtaaatcactcccggctaagactatcgccagtctcaccggtatttcgacaaactcagttcagcgtattttgacggctaatattcatccacacgcgagccgccggttaccgattaatctatgctttggtgaattccgttccacgcacggctccatgtcgtttatttgcattgacgccgacactcacaaatcagttaaagtacttagcgaccgccttaatagaaccatcaaacagttctttcttagtcagtacagcaccgcagaacgggccgcggttcaagcgtcatcatggacatgaacgcctcctatcaggcattcgtgcacgaa

SEQ ID NO: 130 - DNA, 1182 bp, Lactobacillus plantarum
cccgaattgtcaaatcaagtgcaacactttcgacctattcttagttattggtctagttaatcgaagtctggcagaactgccattgccgattgatagttgagaacctttcgtggtctttggttcagagcgttttggattgcttgaatccctgttaaggtcaaggctctcattgaatgtcccttaggaatgaactcgcggatcagttggttctggttctcattagtaccacgttcccatggtgaatatggatgggcaaagtagactgtcgtgccggctacctttgataaatccgcaaactctgaaccgttgtcaaaagtaactgtcttaaagtattctggaccatagtcatcgataacatcttgcagggcttgtcgacaagtgtcggcgtgatagtccgtaatcttaacgatgatttcataacgactaacacgttcagtcaaggtcataatagcgggttcactggcaactcgtttgcctttaactagatcaccttcccaatggccgatttcagttcggttattggctccaaatggtcgttcttcaatagacttgcctaaggtacgtttattcatacgctgatgagctttacgaacagatctcacccgtcgacgtagcttcatgggtagttcactattagttagttctaaaaggccattatcaatgtatctgtagacagttggtgttgacggacaagctagttcttgatggttcagtttgaaccaatgcacaaagctatcaatactgtggactctaggtttgcgacgaagttcaatgaccagttgttggaagaacacaggtgccttgaccagccagctaacggcatgagaattagcttgatgatttgcatgaatagtttgagcagtctctgcaaagtaagcttcaaagggcttgtgattagggccaatttgacgaattgtaccgtgctttaattcccgactgatggtacttggactccgatgaagttcacgcgcaatctgacggcaagaccaaccctcagatttacgagccatgatcaagctacgttcataaggttgaagttgttggtaatgactaatcatggtattctggttaagggtcatgaagacatctcttttcttatttgttgtggtaactataagaataggtcttcatggcctttttggtctagtcatttaggtgttgcacttcaattttaaatccggc

SEQ ID NO: 131 - DNA, 1101 bp, Lactobacillus plantarum
gtatccaaacacgttctaacgcctttgctgccgaacacaacattcccaaagcttatggtaatttagacgagctactggctgatgaacaagtcgacatcgtttacgtggcaacgccccataattatcacattgacacgattttacccgccttacgtgctggcaaacacgtcctcagtgaaaaggccatcacaatgtctagtacccaactcgcaatcgccaaggaagtggctgctagcaaccaccttatcttagcggaagcgatgaccctgtatcacatgccattatacgagaagctccatgattttgcggcagaacgtcatcttggtgatctgaaaatgatccaagctagctttggtagttttaaagaaccagacccaactaatcgcttctttaatcccgaccttgccggcggtgctttactggacattggtgtctatgccctagccttcgtggaagaattcttgactgctaagccatacattaccggaacaaccatgcaccgattcagcagtggcgtcgatgaatcttcgacaatcacgttacgaaacgccaatgatgaactggccaccgttgccttaacgttccgagctaaaatgcctaaacgcggtatcgtcgcgtatgagaatggttactttaccgttgatacctatccacgtgccgacagtgccactttcaccgacagcgaaggccatattgaaaccatcacagccggcgatagcactaacgccatgaattacgaaattgctgacatgcaaaaaatggttgctggcgaattacacaacacgagtcttgctaaaacgactgacgttatggatatcatgactgccgctcgtgcacaatgggacttccgctatccatttgaaaactagttatgaataacatctttatgtaaattaaaaaagcttagataccgtgtgttttttcacacgatatctaagctttttttacccccgtgaaataccattgaaaaaccctaagccataaaatcagaaagccagcttggactcgctgggaaaaatactgcttagtatcaacttggttagttggcgctttctcaaagccatactcgtttaattgaaggactagggactgtctgaaaac

SEQ ID NO: 132 - DNA, 1635 bp, Lactobacillus plantarum
gaatggcggcacaattgggcggcaagtgtaaatcaggatttagagcaaaaaaatattcccgatcggatcagcgaaaaatcatttgtggaacagggaatagctgacacaccaatgcaacacgagggaatcaatagcaaacggcatgaaagaaaggcatttaatcaacaagttaagaactatcgcaaggccaaagccagttataaaaacaaccaagaaaaagtaatcaatagaggtcatttagatagcctaagtaaacacttctcgtttaatgaaaaacgggtagtcaaagagttaagccatgaactgaaaacttatatcagtttggagaacttagatgataaacggcgcatgctatttaattggaaaaacagcaccttaattaaacatgcggttggtgaagatgtgactaaacaattattgacaattaaccaacaagaaagctcacttaaaaaagcagatgaactcttaaataaagtggtcgatcgcacgactaaaaaactttatccagagcttaattttgaacagaccacgcaagctgaaagacgagaattaattaaagaaactaatagtgaacaaacgattttcaaaggcagtgaattaaacgaacgtttaatgaacattcgtaatgatttgttggcccaacaattattgacctttactaagcggccatacgttggttttaagttattaatgcaacaagaaaaggaagtcaaaatcgagcttaaatatacgctgatgattcatgatgatagcttagaaagtctagaacacgttgatcaaggtctactagaaaagtattcaccaaccgagcagcaaaagattactcgcgcagtcaaagatttgcgaacaatcatggctgttaagcaagttattcaaacccaataccaggaagttttaagaagagcctttcctaacggcaattttaatgaattaccaatgattaaacaggaacaagcctatacagccgtgatgtactatgatcctgttttaaagccatgtcaggctggaacaattgaacagtggcaagcaaatccaccacaggtgttcagtccccaagagcatcaacaaggactagcttatctatcggaacagctcagcttagatcagttagaaaatcatcacctacaacgggttttaaagcatgatggcactaaacaactcttttttggcgaatgcaaagccgatccgacgattaagaacagtcagattgagaaaatccaaaagcagttaaaagggcaacaagccaaggacgaccagtacagaaaagaaaatatcggacattatcaaccgctaaattacaagccagttagtccagactattacttaaagacggcctttagtgacgcgatcatgactgttctatatgctcgtgatgaagattaccaacgacaaagacaggcgcaaggtttaaaggagactgagtgggaaatgacgaaaaagcaacggcaacaccaaactcgaaaccggcatgaagatgggggcatgcacttgtaatcaaaaaattagcgactggttaattggtatgaatggtagccctttatacaccttgctattaagacaaaacggggtgcgcggggtgtactcgattggtcgagtacagacgccaaccttgtatatggtctatcaaagagacca

SEQ ID NO: 133 - DNA, 1034 bp, Lactobacillus plantarum
taaatttgcaatctaccttatcataaaggaagaattttaacaaaaaatagtttcttaattatactgctcacaatctgataaaaaataaaaagtaagatatctaaaaagatgaattgtcaaggaaaattaaatacttatgacctgttctgaagcagtagtccaactaatcaaagtctggcatagctcctatggctgatttacaatcaagtatgtcggttcaaagaatcttggatggtttgaattgctatgatctctttatggttgtcagatgaaataatataattcatctgacattccatggagggatttttgtatgccaaggtctagatatacactagccgaaaaactggctttaattaccgagcttcagagctccagtctttctattactgcatttagtaagcaacatgggttggatcatcacaccattggtcaatgggaattacgtcttcaacgcgatagtatcaatggattgattgcaaccactaagaatcagcattacagtaaagcgttcaagcaaatgattattcacgcatatttgaatggcgagggaacacttcaagtctaaattcgtacccgattggcgactctattacgggcagcgcaatcgcttgattacgattaagcggtggcgtgcaaactcattggtcagtctcggatggttgcttggattctacgctcgattggccattcaactctgtggaccgttttatcgtggctatcgcaaaatggttatcagagtttacttggaggcgttacgtgatgcgagtcgcgagtgtgagggcttgaatcccaacttcatgccgggacagaagttttagtgtgggcctgatcgtgagctgtctgatgacatgggaactgtatacgggcgaaaccagtgattattgcaatttaaggtcagattactaaaccaggccgactcaattttggacatcagcttcatcattattagcaacttaaaagcgcgcaactgttagtaaaagtggtgcgtcgtaaaattagttaatgaacagggcaaattctataattaatcc

SEQ ID NO: 134 - DNA, 1644 bp, Lactobacillus plantarum
tggcaaattacaagtttaatccgaacaagcccggaatctttcaatggcagtctgttgatgatgtatttttaatggtcgttgattaattagttcaagtgctgctaggatctcatcagtcgttacttggctaaaattggtctttttcgggaagaaccagcgtaaccgtctattaaaatattcattggaacctcgctcccatggtgaatatggatggcaaaaataaactttgatctgataatcctgttctaaggcctgataattggcaaactctttaccatgatcaacagtaatggattttacttggggaccgaaggcccccataaacttgccaaaggcggtgtttagagccttagccgttctattaggggctttgatagcccatagaagtcgggtcttacgttctacgaatgtaaccagacatgatcgtgactcacttcgactagaaagcaccgtatctacttcccaatgaccaaaagctaaccgttgattaacagttgttggccgttgttcgatggaagtcccacttgtaaatttcccacgattttcgctcactcggtgctggcggacattccgattgggtagatcagtcaatttgaaggggagccagccacgattaagccaattataaattgacgcagtgctcaagttataagcggccgcaatggtttctggtgaccaggttaatcgtaagtgattggtaattaaagtcgctaatgctgccgtcagcatcgaacgacgaccgcaattccgccttttgcgatctgcatcttgctgagctaattctggatcataaggtttaacccggtccaactcatagctaatcgtagctttggcgacgcctaaggcgtcagccattacttggtaagatttattcccctcattgaccagttgtgctagtgcgccacgttgaaaacgtgataaagtagatgtacccaaagtaatcactccctatattggttggaattagctactaccattgtaagtgattgctttgggctttttaatttctgttcggattaattatagaatttgccttatactaaactaatgtaggaaagttaaggcaatggatgctttttatagtctaacagagtagactatatgcttaagggggtcactgaatatgaaaaagagaaagttacttgtctttgctattatagcagttgcacttattttttttggggggatttatctaaattcagacatctacgtaacacatcaagtaaatacaaaggtcaatagagttatccaggcaggaaatacaaaagaacttaaaagaatctcaaatgataaaacaacttacaaatttttaattagtttatccaattccactcgctgcaaagatacgtcagattttcaaggcgggacaaataagaatgcttattatgtaactacacttaataaacaaaaaataggggttcacatgtataaggccagtttattcaattggaggattaaatatgtcgaaaaacaatagagtgtttgtcattttcttttcgattcttttatttttgacagttggcatgagtgaaaaagcttatgccgaacaaatatctggaactgttcacaatgagcttgtagggacttttgataaatcccaaacgtctaatagaactattgaagaggtagattgtaaaattaatc

SEQ ID NO: 135 - DNA, 2018 bp, Lactobacillus plantarum
ccaatggaatcttttcatgcttccctcaaaaaggaatgtgtttatccagtgccggtctttgagaattatgaaactgccgctgctgtcctttttgaatatgtgcatgctttctacaaataggaagagaattcatagttcactgggctaccagacccccttacaagttgaagtcgcaacacttacgagccaaatggccgcctgatttaatgctttccatggttcaaataagttattaatcacgattaatgatttatttgagctgtggaaggtaaacgcggttctgaatgtctcttaaaacctgtctcaaatattgacttcaatccaagaagcgatgaataagattgcagagcaaaaatcagcggctaaaattaccgatcaacctaaaaacttggaagaacaagcaatatcgttagtcgggacggatatttaccaaaagttggtaaagggatacacagaaaaacagtggggacaaaaagcgactgatttaccggcctttattattcgccgtcttccagtccggtacacgtatgataataattatttcaatgatacctaccaagggattccaattggtgggtatacacagattgttgagaaaatgcttgatcatccacagattgatgtgaagacaggtgttgatttttttgacaacaaggaaaagtaccttaaagattacccaagagtcatcttcactggaatgattgaccagtactttaactaccaacttggagaattggagtatcggtcactgcggtttgaaagtgaagagttgagcgttgacaattatcaaggtaatgcagtggtcaattatacagatgcggagaccccgtttacacgaattattgagcataagcattttgaatttggtaaaggtgataagaacaagacggttattacgcgggagtatccagttgattggaaacgaggggatgaaccttattatccagtaaataataaacgtaataatggattgtacaagcaatatacggaattagcaaagcaagaaggtaacgtggtctttggtggccgactgggtcagtatcggtactatgacatgcaccaagtcattcatgcggcgctgttagcggtagaatatgaactgggatagcgcatttagattagccgtattcttggactaggaggactaaacgatgacaattgatacagatagggttcggggaaaatggatttatcactcatgtaaacgagcatttgatttttgcgttagtgcattggcattgattattttatcaccgctttttttaatcattgctgtcgcaattaaattgggggcgtattttattcacaagtcagaattgggaaagatgggcgaaaatttcgaatgtttaaatttcgttcaatgataaccaatgctgaccaaaaactaaaagatcttttgcagtataatgaaatcgatggtgcgatgtttaaaatgaaggaagacccgcgtattacaaaggtcggaaaattcattcgaaagcacagcctagatgagctaccacaattactgaacgttttagctggtgatatgtctttggtaggacctaggcctccattgccacgggaagtaaagcagtatggtgtatctgatattcagcggctattagtagtgccaggatgcactgggctttggcaagttagtgggcgaaataacgttggttttcacaaaatggtggaactagacttgcaatatattagtgaagccaatctttgggttgattttgttatcttgcttaagacttttcgtattattattagccctaatgatgcttattaagggtgttagttaatgctgttcaaaagtttgaattgatgacgactgtttttaaagtgcctatgtgagggaagtttcttgaataaaattataaaaatggtagattgcaaatttaatccgaatttttggacaaatttgtcagcataacctgatacggtgtttgccagtcgagtattttaagcggtcgctggttaatttggagtaacgtcgtcgttaaatcttgagcactaatgtgctcaaaacg

SEQ ID NO: 136 - DNA, 942 bp, Lactobacillus plantarum
agtatccaaacacgttcttaacctcgcgttacctgcaattacaagaatccccggtcagtaattgaccggggattctttggttatcatttaaagtcgtcttactcttggcaatcacttcagagctaaatatcacaagatagccgcattgccttcgtctcttgacggtcgacagggtaaatctcgataataatactgttaccgaccggatgccaatcaattgctttaaccagtgcccgcataaacgtccgcgtgatctgagtcttgattgaaataccgctacgctcaatgtcatcatagaaaatgacccgttgatctagcttatcaaccttaaagtagtagtacgcataatgggccgtcccccgtttcaaaattaagtggtacgaattattataatccgcgggaaaaaccgtgatccaatcgtcattcatatcggacatccttttcacttgaatttgagctctaatctaattgtaccttgaacggtggtgaaaacctagggggaatgtgtgagaaatcacgcgagaaagccaccgtagcaacctaaaatttgccagcttactttcgaacgatgggccaatatcagcagccattgtaaccatagccacaaaaagattcattaatttggactatcttctacttaatgaccgtgataagaacgagctctttacgcttcattcagcttataacttattctaaccgtatgtcttaaattacgcgattgctaggttaacacatagttaatgcttagcaaatatttattcaccaattggcagagtcatcactatcataccgtttttagtactataatcacctcaattattttttcatagattgattcactttcccctcatattttatcccggtcacaattattaggcctaaacccataactcatcagaatacgtagctgatattttttctgtggcaaattacaagtttaat

SEQ ID NO: 137 - DNA, 915 bp, Lactobacillus plantarum
cataggacgcgcaccggctgatgaacaggaatctaaaattggcatgttttaatcatgattaaagatagattaacttgcacgatgtgaattgaatcgataactattgaactaatgatatttaatttactgacaatcaatttataaccaccggcggcttaggcgcgtcggtaagctaattaataggactgatgtacgatgaatgtaaagatcctactagggattgtgatatggttatacggactgtcagtgctcaaaagggctcggctatctgccttctacttcattgtgggaagcgccgggctcttttttatcttgacggcaattagtcgtccgtattgggtgtggttttttacccacgctgtgattcatggggtagcgctgtttagtgatattaccggttggtgcagtattatgttcaaaatgggcctggtctacattattaatagtggtaatccggtaatcatgtcgattgattatgaatgctcgggaatcattgagacgtgcgcatttatttcgctagtagccttttacccggcttaccagcgccgtgaaaaggtgttttatggtgtttttggattgttgtatatttacttgattaatgtattacgcctgtccgtagtgattgtgattgttcactttggcggtggtcaaacattctttctggctcattcagtgattgggcggttactgttctatgttctggtcattgtcttatattacaatgtttttacctattcacagttagctcgaggactttatcagcagtttattgattggagggagcgaatcctgtgatgtactggataaacttagcgctgactagaatggggttttggattacctgggccttagtgccgatcgtggtggaaattattccggcaattatgtcgactattaagaacgtgtttggatact

SEQ ID NO: 138 - DNA, 853 bp, Lactobacillus plantarum
gattctaaacacgttcttagtctggtgctaggagtcgcactattcttaagcgataatttcacgaattttaatcaatatttatttagtttgccggtcgctcgaaagcaaatttatcggcgtaagatcgggttacttattgggatgttggtcagcgcatacatgttggcggaagctgtttttggactgattgcttggcgcgtgttggctaaacagcaggtgcggattgattggcttacgacattgtatgaagaacttggaatcctggcagtaatgttagtgtttggattattagccgctacgttcgggttatgggttggccatatctttgcgagtgcgcttgcgacatttgtcttcgtttgtagcttgccctttgcatatgatggcttgatcaatcttgctgcaggattaacgaagcttaaatatgagcaggtggatgttttaggtcagctgccgagctggaaacccgggggcttactaaccacttgggtgatttgtggtgttatcggtggcggcctgtatttgcttaaccgctgggcgtttgagcatttatctttggaaaatagtggggattttttccgctttccgcagtggcgcggagccgtcctgggcttttcaattatttatctaattgttgcaatttgctgttcacaatttggtaacggtgttttagggttgctaacggataactatcatgcgcatatgccattatcgactgggattataatggcgctggtcgttgcctatctaacttggagtttggggcggtggtttctgtaccgaccggatcgttttcgcgatgcgtggacggttaagaagttggcttaacttggtcataaggtagattgtaaaatta

SEQ ID NO: 139 - DNA, 823 bp, Lactobacillus plantarum
tagggactgtctgaaaactaaaaattcaggtataatctgaggaaaaacgaatcgaggcattccgatgacaacacctaaacgatacgaactggaagatgctcagtgggaccgaatcaaaggatacttcccgccataccggactggccgtccatcaagcctagacaaccgtaccgccctcaacgctatcctctggctcatgcgcagcggggctccttggcgtgatctacctgaacgctatggctcttggaaaacggtgtatagtcgcttccgagcctgggtaagttcaggcttgttcgaacaggtttttctcgaattgattgacgatcccgacatggaaaacttgagcttagattcaacgatcgttcgagcgcatcaaaaggccactggggcaaaaaaaacgccgaatgtatggtcgaaaatcaagctattggattaagtcgaggtggccgaacgaccaagattcacgcactcgttgacggattagggaatcccttgggttttcgcctaacaggtggtcaagtacatgatagccaagttgccagtgagttgctggaaggcttcgatatttctcaatcaaatattatcgcggataaagcctatggcaccgcgaaacttcgccagtatattgaagataaagcaggcgtctataccattccgccaaaggaaaataccaaagacaagtggacctgtgattaccacgtttattgtgagcgccatttgattgagaacttcttcaatcagttgaagaactttcgtaggattgcaacgcgttatgataagctcgctcatgtttatctggctacggtctacattgcctcaattt

SEQ ID NO: 140 - DNA, 789 bp, Lactobacillus plantarum
caagattcttgacgctacctaagtaccaaaacctaaagtaccaccgtttgtatgatattttggaatttcaaactcattaaaattatttttggatccatggtagagtgtgttttcaatattcattagttactccttttcttctcaacagaaccctgtgtttagtgtttcttttctggttttgaaaaggaacactaaatgcgaggtataccaactgaaacgtagtgtaaggcggtagttaattcccaacattcgtattatttgttttaacgtcatttattcgttacactataattgtaagcgtattcaaaaaaatagttgaaatgggagggatttatatgttggaaagaaatttaacagttattggaagttacagtacgagagaagaagctttagccgtgatgatatcattatttacaccaacaaagatgcagctacaaattttggttttgctggactgtcaggaatcgatgttaaaaccggcgtaaatggcgtcgaaacgactcacgaagatcgctcactatggaaaaaaatcaaagatgcattttctgctgatacgtacgaatacgattcaagtttaaatgaagaagctgaccatgcaaacaacgacccgctttaccaatatagagatgatatctcagctggaaaaattattatcaccgtcaataattataaaaacgacccaacacaagcaactgaaaatgttacaggcagacatgcagctggtgacactagcacaaataatttacatgcatcagatgctgcacgtgcgacctatcccaaattaatcaa

SEQ ID NO: 141 - DNA, 742 bp, Lactobacillus plantarum
tcaggcattcgtgcacgaactattccctaacgccgaactcattattgatcggttccacattattcaattaataggccggacgatggataccattcgcactcaatgtttaaagcaactcgacaagcattcgcgggaatataaagtactgaaatcactatggcgcctattccacaaggccaaccctgacgcacaaaagagccgctacctcttcggcctgaatgagtactcgaccgaacagaacgctattgatattggaaccaatacgtttccggccttcaaaacagcttatgaaacctacatcgatctccacgatgctttgatggggtgtcacgctgatgaactcaagaatatcatcactaactatcagcctaacggcacgcccctagatacgaccatgcataccctacgaaagaatcttaatggcgtaattaacgccgccaaatcgtcctactctaacggaccgatagagggcatcaaccgtaagatcaaggagctcaaacgtgcttgttatggcttctccaatcaggccaatatgttcacacgcgtctaccatctgattgcctagattatctaccacaataacgtcacgatggtaggcttatttgttatgccttcaagtacgatattcagacaacacaccagattaaacgccgcaactaataaaacaacaaaaaagatctcccacacgaggagatctccaaagaatagaaactatccttcaacaccatttgacaaacttcca

SEQ ID NO: 142 - DNA, 1426 bp, Lactobacillus plantarum
agtatccaaacacgttctaatattggggttctaaaacggctttagacccattttaaatataatctaatataagaatgttcccgttcgcttaaaacgtcttaaacaagcttatatggtgtttaactccaagtgcgttcattgccagcgttctgttcctcgggatgtttagcagcatattctctagccgcttgtttattccaccaaaccccaaataggttttgcatggtgccgtacaagtagttttcaacgttcttgatgtgtttctcattgcttctaagggcgttaaagtagcgtctcaaggctttagtcatcaaaggcttcaggtcctcatcatcaagtgggattatgacgccaatgtcctgatgatccttttcaactcgatatttagcattcaagatgataccaataaaccggcgcatttgttgcggggtgcggcaccagaaacttagtaattgcacggcttcgggttctaagaaaacgggtaagccactatcttcatcagttaagaaatcattagcatggttcaccaaatcctggttttgcttttctagttctgctggtgagaattgggctgtggaaaagtccaacttttgagtatctatattatatctattagtatctaaattattagtatagtctagattgtgactctttttgacactttcgcgtgtatcaagggtttgtggtgtatctttaacgaacttccgcgaaggttccgttttgacactttcgcgtgtatcaagggttttaacgaacttccgcgaaggttccgttttgacactttcgcgtgtaccaagggttcgtggctcttgttgccgagattttgtataaatgtctgttgccgtaacttctaaatctgctaaatacaatctatttggttcatttttaccagttttgggattaaagtgcatggttttctgaaataataatccttggttttcaagttcattttttaccctaatcactttcttttttgaccagcccataagatctgttagttcttgatttgtaaaaatgaaataaacccggttatcttcatcaacccagttgtttttcaatgaataatctagtctatcgtgtaaaatcatatatcctaattttgcactatcacttaatgtcttatattgagatccataaattaaaacctgtgggaattggaaaaaacgagttgcataagctttttccgactcaataaaattgaaattagtttgattcattataaaacttcccttctcaactgacacatactgtctcgaaagagagttgctaaaacattagatttgctttaaaatacaaatctgatatgctttaactaaattacaaagcattcatttagccgtgaggctttgtaatttaccagcatgtgtctattcttggttgcccattcggcaacttttttaatttctggtagattgcaaatttaatc

SEQ ID NO: 143 - DNA, 734 bp, Lactobacillus plantarum
tttcaaagatctaattccgtgcgttaatcgcttaacacaactattacataatatcatttcatcatttccttgtcaacaactttatttaagaagttgaataactatgcaaatgaatttgaaacgttattaccataacataatcgttaacacctcaatcagttgaattgttaacgcgacaagaaatatcttatcattagcgattactcatgtcaataacttttttgctgttttgaatatttattcacttacaacaatttgaaatgaaacaatgtaagtgctagcggctagctgtttaacagcagtgctcgcagcgacaagatatatattatcaagtattagtatgcaggtcaaccctttattcgaatttattttgataaattcgtaaacggcattgtttcactcacacgaacactcgtaaataactcgtgcaattcactggctagaacaaactcgagcccttgacgatcaaactttgcacgtacctgcccgtcaacagctagttggtcaaagacaaagaccgcaactttttcatcatccaactcagccataatcgaatcatacaagcgcaattggtcaacatcaataccaatcgtatatcgcaaatcccacaatactgacgctaagggcgaatgccctgctcgtactggcaactgataaaaattgtatccattagtagaatgcttaactaaaaagtgcgacccttgctggtcattatgaagtgaacccacaagttt

SEQ ID NO: 144 - DNA, 2204 bp, Lactobacillus plantarum
tgaagtgaacccccgagattggacaacaatctcgggggttttactatgactaaatttaatttagagttacggatttctattgtgacacaatatttaacgggtattagttccattcaattggccagaaaataccatgttgccaacaatgaaacgattctcctatgggttcatcgctttaatcgttttggcattgcaggattaaaaccgaaacctatgaatttggaatactctagtgagttcaagatagaagtattaaactggaaacaacagcacaaagcttcgcttccagaaacagcactacatttcaacctctcttcaccaagtactatctggcaatggcaaagaaagtttgatttagaggggctcagtagactaaatagagtgagaggaaatccaaagactatgtctaaacataaaaaagtgaccaaacccacaacggcacaaatccaagcacgccacgataaagatgagttaaagcaactcaagcaagaaaataagatgttaagaatcgagaacgaatttttaaaaaaactcgatgccttagatcacgaaaaatcagctcacgagaaaccgtgaccttaattgatgatctgaggcgggtcttcaaaacgtcgattagttttatccttaaagccgttaaggtaccacgtagcacgtactattacactaagcacagtcagggacgaaaatatgaggatgaccaggttatccaagccattgatgaaattcggcaaacagatgccaagtatactcaaaaatacggttaccgtcgcataacgttagttatgcatgaacagggatttaaagttaatcataaacgcgtcctccgaattatgaaggagcaaggctggacatgtcaggcctttaataagcaaactcgcaaatataactcatacaaaggaactgttggtagaatcgccaaaaataagttacaccgtcgattcaagacagatcgaccatatcaaaaactcgtcgccgacgttagtgaatttcgatacggtcagatgagtcaaagcgagcgaatctatttagaacccatcatggatttattttcgggtgaaattttggcatttaacattagcgcacacccaactcttgaatttgcgttgaaaccactaaaagaagcattagatggattacctgagcttccttatagaacaacggtacacacagatcaaggatttcagtatcaacataaacagtggcaaaaaacgcttaaaactcatcatacctttcagagtatgtcccgtaaggcgacttgcttagataacgccgccatggaatcattttttcatctcatgaaagcagagatgatggatgaacacttcgaaaattcagaaagtctcgcgcaagcgatgactgaatggattgaattttataataaccgtagaatcaggaccaaactaaaaggcaagtcaccggtacaataccgagaacttgccaatcagttagcagcttaatttagttgtccaaacttgtgggttcacttcatgcacttcaagtctagttcaaccttttttaatattaactggccttattatgactgcggaaaaacaatttgggtatcgatggttgagttggtacccagcaaaataaaagagcggctatgtggtgggcatgataattcccttagcagctaaattgcggacacattctgctaagtagctggcgttgtgttctggatagattggtgttgttaatgcaataggagtgaggtgatcataaggcgggcaaaactgcccacgataatttggatcataccatattttattaggatgatagccgcgaagttgcatttcatccatcactaatacatgaaattgatacaacttgtaaggggaatatttgaaaacataattaacggttgcatgatttttaccccaaccattgcctctcaatgcggcaagctcacggtgttgacctagtaattgttgtcgtggtaattgatggattaattgttcatgccatagacgcataggccacactcccttatcgaattttaaaattaacaggtgaatattaaaaggaccaactcatcattatgatgccgaatatactgatacttttgaacgggtgatgattgtaaacgacggatagttaaagtgaatattcgcaattattatagcatagcgaattgatcaatagtttagtacaagatcaaaaaaacggccatagcaacaactgatatggtagattgtaaaatt

SEQ ID NO: 145 - DNA, 388 bp, Lactobacillus plantarum
ggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgtt

SEQ ID NO: 146 - DNA, 707 bp, Lactobacillus plantarum
aaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgttaaacagagaagctggctgttatccactgagaagcgaacgaaacagtcgggaaaatctcccattatcgtagagatccgcattattaatctcaggagcc

SEQ ID NO: 147 - DNA, 717 bp, Lactobacillus plantarum
ctccaggcaccagttgaagagcgttgatcaatggcctgttcaaaaacagttctcatccggatctgacctttaccaacttcatccgtttcacgtacaacattttttagaaccatgcttccccaggcatcccgaatttgctcctccatccacggggactgagagccattactattgctgtatttggtaagcaaaatacgtacatcaggctcgaaccctttaagatcaacgttcttgagcagatcacgaagcatatcgaaaaactgcagtgcggaggtgtagtcaaacaactcagcaggcgtgggaacaatcagcacatcagcagcacatacgacattaatcgtgccgatacccaggttaggcgcgctgtcaataactatgacatcatagtcatgagcaacagtttcaatggccagtcggagcatcaggtgtggatcggtgggcagtttaccttcatcaaatttgcccattaactcagtttcaatacggtgcagagccagacaggaaggaataatgtcaagccccggccagcaagtgggctttattgcataagtgacatcgtccttttccccaagatagaaaggcaggagagtgtcttctgcatgaatatgaagatctggtacccatccgtgatacattgaggctgttccctgggggtcgttaccttccacgagcaaaacacgtagccccttcagagccagatcctgagcaagatgaaca

SEQ ID NO: 148 - DNA, 668 bp, Lactobacillus plantarum
ttgctcctatcctagtatttggtacataaatttctgaacagttgtgccataattaataaaacaagataggagcattccaatgaaacgatatcaagatgattttaaagccagcattgtgaagatgcatcgtgaagagaaaagatctattcgctcgctttccgaggaatacggtgtttctccagccgcaattcataactgggttaaaggcgctaaatcagttgagctagaagacggtactgaagtaacgtccaaagaattcaaacaacttcaaaaggaaaatcagagattaaaggaggaacttgaaattttaaaagctgcggcggtgttactgggaaagcattaggacgaattaattgccttgtcttcatagaagatcagttattgcgacaccgcttatcaattattctttcggcactgaaattaccgcgcaacacctattaccattggaaaagatatcaacctagtcaacacgaacgtgttgataatcagctcaaagaaaaaattaaattgatttggaaaaataattatcgtgcctatggttatccacgaataacgatggtgcttcgcaagtcaggcatctgtgttgggtcaaaacgaattttacgattaatgagggaaatggagattcactctttaatgaatcggcgatttaaaaaacctggcactca

SEQ ID NO: 149 - DNA, 664 bp, Lactobacillus plantarum
caagatattttacgctctcgaaaactatggcttcgcccaaacggatcaacggagcgatctatattcgttaggggtcgttctaaactgtttgttgactggtcaagagccgagcgggccgttagatacaacgacactgacacaggattcaacatgggccccgattattatgaaggccacggccctagacccacagcaacgatatcaaagtgcgactgcaatgttagcagcgttacctggtcatgagcattatcggccgcaccgtcaatcaatgattaagcgaatacaggcccggcaatggtggccgaaagtcaaacgacctttacaaatcagtttgtggggcctctacatcttgctcgtagttgcgaccattggtgctggctttgataacacgacttggcccgcccgcgtcgatttttggaccgagggttttatgattatcggggcgccactgattgcgcactatgccaatcagtggttaaaacaccattggtcggtattacgttggcaccgatatcggtggtggttacgagtagcagaagccatcttcatatttttgatgttaggccgtaacggctagtgtacgtaggctggttaaccaattactagtacgataaatagcataaccgtttagttatcaaaaggcttgccggatttaaaattgaag

SEQ ID NO: 150 - DNA, 651 bp, Lactobacillus plantarum
ttaaatttgcaatctaccacttaactagtgaattttgacgggttaatttgtcgggaagtcggattatagtgacacttaactagtcattttattgcttggagacgtggcactgactaattatttttcggtaaagcagataattgatagaagttgcgcatcgtgtagtcacttgtggtcggttaacgaaggcgtcgattaattaagtattactatagtaggtttatgccaaaagtagcccatgacgatcgctactaaaacgttactaggttagtattacgccatagctgaatggtatgtggttgtcgttgtggactagtcgtcaaactgtcgggggttcgggactgtacttagtcaggaaattagttggattttctccgttaaggttggtgaattgttaaataaaaacatgtggtattttggttgggagagtgggtcgtcgattgggggagacaactagcaggtctggatcgtgtccgtcttaaagcggttgctagaataagcatatcgcatatctaaataacgggttgtcagcatgctctaaggcccattataaagtcacttagcaactgagtaactttataatgggtattggtgggggacacacgtgcttcagcacggatttaatagtagaaaaaaagattgcgaatcaga

SEQ ID NO: 151 - DNA, 632 bp, Lactobacillus plantarum
agaatagtccatggtgttggtatcaagtaaaattgcttggtcctttttacccattccaacagcaaattgatccatgatcccggagttaacaccaacatagttgttttcgcacttttgaccaatcttaacaagatccaattggctaataccgagattaaagccagtgttcaacatgattccagttaataattcaattgatgcagatgatgataatccagcaccatcaggcatgttgccatggacgtagaaatcaaagccatgatcgaatttaacgccggtctttgcgatttcgtccatcattcccttaggataatttgtccaaccagcggctttgtcatatgacaggtcgttgacatcaaacgtaacgaccccagcatctggaatattagctgagtacatccgcactgtcgtatctgtccggggtgcataaacaccatatgtcccgattgtaatcgcacatgggaaaacatggcccccgttataatcagtatgttcaccgatcaagttaattcgaccaggtgagaaaaagacccgttctggcttggtatcaaaggcttcggtaaactcctgttttaagtcgctagtattcatgaaaaatccctccgtaaatagttttactaaaattttattag

SEQ ID NO: 152 - DNA, 1526 bp, Lactobacillus plantarum
agattctaaacacgttcttaagggcttttaatttagtttcttgtttttctaagttactttgagacataacgatccctccaatcatattagaagtaatcaccgaaactatatcatataggaaacgttaagtcaaagtataaaagttgaaatagcgaagcggaaggcatacactataagtaaatttaggagaatcagaagactgagtgaaacgaggtcaatgcgcacttacacatagaataaattctatgttgtgataacccccaaaaaacctgtattagaagtcgccgatggcgacaacagaagtcaaacccatagaatcaaagtaaagaggtgactgacatggcaatatttcacatgagttttagtaatattagtgctgggaaaggacgaagtgcgattgccagtgccgcttatcgaagtggtgaaaaattatttgatgataaagaaggtcgccactatttctatgcccgctcggtaattccagaaagctttattttaacccccaaaaatgcaccagcatgggccagtgatcgagaacaattatggaatgaagttgaaaagaaagatcgtaaatcaaactcacggtatgcaaaagaatttaacgtggctttaccggtagaattaagtgaatccgaacagaaagaattactgacaaaatatgtgcaagaaaattttgttgatgagggcatggtagccgacgtggcaattcatcgcgaccacccagataatccgcacgctcatgtgatgttaactaatcggccgtttaattcagatggaacatggggaattaagagcaaaaagcaatatattttagatgataatggcaacaaaacatataccggaactagcaagtaccctaagagtagaaagatactgatggtcgattgggataaaaaagaaaaaataactgaatggcggcacaattgggcgttaagtgttaatcagttcttagcacaaaaaaatattccggatcggattagtgaaaaatcgtttgtcaatcaagggattcaagagacacctactcaacacgaaggcattaacagccaaagaaaaaatcgaaaagcatttaatcaacaagttagcgcacaaagaagcgcccaagctaaatatcataatcttgacgaaaagattagaaatcatgaacactttgacgcgttaactgacgagctatcattctctgaaaaacacacaattagccatctaagtcagcaattgaaaacctatgtcgatttagaacatttagacgataaacagcgcatgctgtttaattggaaaaacagcttattaatcaaacatgccattggtgaagatgtaactaaacaactgctgactattgaccagcaaacgacatccctagcacaagctaaccagttgttaaataaagtggtggaactagcaacgaaaaagctttatccggaacttaattttgaacagacaaccgcagctgaacgacgggaactgattaaagaaactaatagtgaacaaacgattttcaaaggcagtgaattaaacgaacgtttaatgaa

SEQ ID NO: 153 - DNA, 593 bp, Lactobacillus plantarum
ttttaagacggaccctagttgatagaacattttataaggcttttagctttctaaaattaacactaaattctaatttaatataaaataattaatagcattcaaatgctgaaaatacgcaattggtattaaaaatctaattaaacaaaaaaaacaaaactgaaattatcaacaataaagtaccgctattaaaatggctatgattgttcgcagcatgtaatttacagttattgcgactaattataataaaccgcaagattgatatgctaagcatacctaaaaagcagtggcgacaataggcatcatcctactaagcccttacgatcattttgatacttcggcattcaaatagctaacattcttatatcaaaaaagcagctttgcgtttgcgcaaagctgccaatcattttatgtctatttaaaaataaaaaggcgagaaccacgtcccacctcacaagtgccggctaccagagtcgaactgatgaccctcggtttacgataccgatgctctaccaactgagctaagccggcatgatataaaaatagatgttaacacaattgccaacatctatgtcactccgacaggcgggctcgaa

SEQ ID NO: 154 - DNA, 552 bp, Lactobacillus plantarum
aattttacaatctaccatattcgtactttccgtcagtaacttcacatagccctttttgttgttctacagaccctagtatatggaaaaactgactaacactgccactctctgtctgcatcggcaacgagtttaatttagtaaaagcggctctgacaaatctagacattgaggacaagtctccaggtaatcctagtccgcccattcctctactataactatctaaatccactttttccgaaaaactattttggggtgtgctatttgataaggcacgatagttgttcaaattaaataattggtagtcaaaattaggattgtttgttaacacacctactggattgtcgtaaatttttagtccttctttaacactttcaataactatcgattcctgtttatcagcaaccaaccaatgtagcggtgataatggtaattgttcactaaaattaatattaaccaagtttagtttttgtatgttctttttcacttctctaacacttgaaaattgtcccaataaccaaggaattaattcaaacccaaattgcaagaacaaat

SEQ ID NO: 155 - DNA, 544 bp, Lactobacillus plantarum
gtagtccagttgcaataaagtaccttgtaaagtcgtcctagcatggtttagtcgggtttgcgcattattcatgattagtcgccccctgtgagttatcatcgctgtaatccgagttaccaccatccaaaatggagttaataccgtcattaatcccgtttacagtgctattaatgtcatcaataaccccatttaaaccagctgtctcctcatcaatattcattgctagtgtacccatttcagttagtacgcacatcacgctgtaaatagtcgtttctcgattttcaagtgtttttcgtagtctgtcagcgtctaactcaaaataatcaggcgcattactaattaagtgtttcaacgttggttcaactaaatcactaatggctaaaatgctgctatttgctttattgacccgttctagtaaaatacccgcgtgcttgcacgccgcgctaatatcatttaactttgatagttcataaattgggttacccattgtgtttactcctcattttgtagtaaaatgagtatacaaaaagcccataacagtagt

SEQ ID NO: 156 - DNA, 507 bp, Lactobacillus plantarum
tttttctaaacactcgttctaattctgtcggaattaaaccaactgatgtaatttgaggttcggattaccaagtcctcaaaattggaaaaagttgtttgaaaggcaaactctctcttcaacaatgagtgaaaagcttcaattggcccattatcataaggataaccttgttttgagtatgagtggctaatctgatgccgttcaagtaaagtttcaacttcgttgctggtgtactgtgaacccatgtcagagtgaaaatattgtggcttttgatgacattcaagcgcctgattaatcgtttctacaactaacgtcgcctccatctgacgaccaatcttgaaagcaaggacttgatgaacctttggttcgtaaatagaactgagataaacccaggttcctggacgtaattccaaataagtaatgtcagcacgccatatccttgcattgggctggtgcttgattaaattggggcgttgtgaatgatccacatgagtgccaggttttttaaat

SEQ ID NO: 157 - DNA, 496 bp, Lactobacillus plantarum
aacactcactagttatactagtcactgttgattggttgagacatcaactgctcgaccaatagaaaatatatgtaaataatcgaacacacgcaaattataggagggtgtattaattattatgaaaatcaaaaaccttgtattatcatcaactgctgcattagctttattcgctatctcaacaacggttgccaacgctgatacttatactgttaaggccggcgatactgtttcagcaattgcccaagctcacaacacttcagtttcagccattgaaaaggcaaacaagttagctaatgttaacttaatcttcattggtgataagcttgaagtcaatggtactactacaacaaccacgacttctgctgctacaagtgctgcaccacaatcagcaactagccaagctacttcttcagctgcttcaactgcaacgagtgccagtgcaactagtgcttcttcacaatcagttgctagccaagctactagttctgctgctact

SEQ ID NO: 158 - DNA, 492 bp, Lactobacillus plantarum
ttgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatca

SEQ ID NO: 159 - DNA, 483 bp, Lactobacillus plantarum
gatgagttaaagcaaaaaattttaaaccatttacggctaagctggtcaccaggaatgattgctcacgaatttaaactagcgactaaatcaatttataattggttaaatcaagggaaaattgagttttctttaaatgatttgcctgaacatggcgtgcgccaacggcgtaaccttgaccaacgttctaaatataatcaatcattaggacggtcaattgaacagcgacccatcgtggttaatcaacgtaagcgcatcggtgattttgaattagatacaattgttggcccccgtgggcatagtaaggcagttttattaaccttaatcgatcgcaaatcacgtttcctttgggcctaccgattaaaaaaccggacagcagtaactgttaatgaagccctaaataagtttctagcaacttttaatggcccggtgcatagttttacggtggaccgtggcactgagtttagtgggctagtatcacttgaa

SEQ ID NO: 160 - DNA, 478 bp, Lactobacillus plantarum
aaaagccctgggcttccttgcgcagaagtaaccaatatctttgattacattcaccaagaaagccataaccaccaggtaactaagatgtgccgaatcctcggtgtttccagagctcagtattatcgttatcgatccccaaagccttcaaaacgccgggccgaagatgaggacttaaaacaacggattctgcggatctttgcggaattcaagcagcgatacggcgttatgaagatccaccatgaattgaatctggaacttcaaccactgcagcgtcggtgcagcccaagacggatttcccggctcatgaaggaactggatatccactccgttaccgtcaataaatggaaagcggcttcggcttccaaaaccaaggttgaacagcgtcccaacttgcttaagcaggatttctcgaccactggtttaaatcaaaaatggaccgctgatatgacctatattcaaacgaagcgtaatggctggt

SEQ ID NO: 161 - DNA, 461 bp, Lactobacillus plantarum
gagtggtattggttaaagcgactggcttagagaccaaacccagatacttcgtcagattagccactaaataatcaaattcttcatcagtgatataagcacaatccgttcggggataactcagcaacttggcttcatataaactttgaatggccgctaaggtttggctggcactggcgtgataacgtttattcatggcactttggagactggatagtgagaatagttggggactagcacgctttttgccttgtttttggacgtccttgattaaaccgtcctgcgagcctttatgaacgtgtttagctcgcatgaatgtcattagccctgtttcgtctttaaatcgctgataggggtctaattttgcgacgaatttttgctgattagcaagaatttcagcatttagttcaaaatagggttccggcttaaagtttttgattgcctggtctctttgatagaccata

SEQ ID NO: 162 - DNA, 452 bp, Lactobacillus plantarum
aatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcaatctcgtatgccgtatggctcaggcatcgtctctctgaaaatcgactggatcatagagcgttaccagctgcctcaaagttaccagcgtatgcctgacttccgccgccgcttcctgcaggtctgtgttaatgagatcaacagcagaa

SEQ ID NO: 163 - DNA, 440 bp, Lactobacillus plantarum
ccacttgtattgtcgatcagactatcagcgtgagactacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgttaaccgggctgcatccgatgcaagtgtgtcgctgtcgacgagctcgcgagctcggacatgaggttgccccgtattcagtgtcgctgatttgtattgtctgaagttgcttttacgttaagttgatgcagatcaattaatacgatacctgcgtcataattgattatttgacgtggtttgatggcctccacgcacgttgtgatatgtagatgataatcattatc

SEQ ID NO: 164 - DNA, 425 bp, Lactobacillus plantarum
atcggtacttccatgccagtgctggtctttgcccgctgtaacaacaagtagtgggccgtgccaaagacggcaccaactagcgcagggactaaccaatccattccactgctggcaagtggtaagaagctttggacatgcgccattgcttggccgaaagtactttggctaacgacggcggggaaagcggcaaccatatcaaagacggcggggacgacggtgaagacgacgacccaaacatagacgacacttgacttgtggaagagtggcgaaaggatcgataagaagattagtgccatggctaacgggtaaaggaacatcaggacgggggtggaccaggcaatgatctgatttaagcccacattagcagttaaaaatgaggcgaggcacgtgattcttaaccaggctttgtaactcaagaaaccgaa

SEQ ID NO: 165 - DNA, 419 bp, Lactobacillus plantarum
tagaacgagtgtttagaaaaaagatgtgccatttattgacataggagcaaatgtgctgtatctaattcaaggtagggacctttaattccaagagcagctttggtagaataattcatgaaggatggtcctttctttacgaagacggggttccgagccatcttccgttttttattttaaatttaaaccaaaataagtaccgatgttaaatccatcagtacttaaaattgtagagtcttttattccgccaaaattggactggtcaggccgtgcgcaatttagccgtttatgccagtgaattagttcctaataccggccagcagttaactttatttaccgatccgcaacgccaaatcaaagccgaacgacttaacggggtcattgacgagattcaccggcggttcggtttcttgagttacaaa

SEQ ID NO: 166 - DNA, 408 bp, Lactobacillus plantarum
tcgctttaaccaataccactccgaacaaacgctatgttgatgggaaaaaagttgaagaacactatgccattattatgactaaagtcgtcccgactaaagatcaattagctaccttacctaaaatacagcatcaagtctatgacttagttttaaaaaacacgttagcgatgtttgctgatccttacgaatatgaagaaaccaccattgttacccaagtcggcgatgctaattttaaagcaaccggtaaggtcccaactaagcaaggttggcaagcattatttgatgaaaacaaagccgaccagcaagaagcagccaccctaccgattgttcaccaaggcgaccaagttccagcgaatctgcaaacaccacaaaaagaaatgacaccaccgggatcatccaatttaattg

SEQ ID NO: 167 - DNA, 397 bp, Lactobacillus plantarum
ggccacaactgttaagttgtggcacattttcttcttgcttattctcttcttttaccaagtccatgttaattatcgtgttgaaatgagaaaaaatacgctaatgattagcacactaaaaacatctactgattacaaatatcactctgatatagttatagaggctaaatgtcagttagaaaccctgaacgtatggtattttttaactatttcatatcaacttggatagcaatctctttcaatgccctgcttaaagctttgctaatttgatctggagataagggagcactcttcttaaaaagcgtatccagtagaacaccgaacccaccaattgagtacgttagcatgtactcataatgctggttattcaaactgcctttttgctcctatcctagtattt

SEQ ID NO: 168 - DNA, 396 bp, Lactobacillus plantarum
gcttgccgattttcgtagtatttagattgccgtaatttaaaatcttctcgctcaattttttgttttaaacgcgcttgttgctcaactagtttttcatattgattaggcatagtcattaccacctaactattatcggttattttgagcttgatttaaaaagtcggcaacttttttagcaatcattttaatctgtggagtagtaagtgtcccataatccaaattggctgatctaatgatttgcttaccgagattttgttcaattttatttttttcagctttaatcttttgattaagctgttttaatttggcttcttgtttttctaagttactttgagacataatgatccctccaatcgtattaaaaataatcaccgacactatatcatacagagaacg

SEQ ID NO: 169 - DNA, 364 bp, Lactobacillus plantarum
ttcgaatcctgttttcccgattaagtagtcatatacgattatttaacacatcgcggtgtagctcagctggctagagcgtccggttcatacccgggaggtcgagggttcgattccccctgccgcgataggaattagagcttggacctttagctcagttggttagagcagacggctcataaccgtccggtcgtaggttcgagccctacaaggtccatctactattaatagtggacatttcctagttacatcatatggaggattacccaagtctggctgaagggaacggtcttgaaaaccgtcaggtgggtcaaaccacgcgagagttcgaatctctcatcctccttattatcgcgggatggagcag

SEQ ID NO: 170 - DNA, 333 bp, Lactobacillus plantarum
ctaaatctatttataattggctaaatcaggggagaattgatttctccttgaatgatctacctgaacatggcgtacgccaacggcgtaacgttgaccaacgatccaaatataatcaatctttggggcgatcaattgaacagcgtcccatgatgattaatcaacgtaatcgcatcggcgattttgaactagatacagtcgttggtcctcgtgggcatagtaaggcagttttattaactttaatcgatcgcaaatcacggttcctttgggcataccggttaaaagatcggacgacagcgactgttaatgaagcactaactaagttcctaaccactt

SEQ ID NO: 171 - DNA, 328 bp, Lactobacillus plantarum
acaagattcttgacgctaccctattaatgcgtcttgcaaataattaaaccattttaaagtactgattctgtaaagccaatcaattatggactgaatattatatttcttcattgattgtttcaccatttaaatcatacaaaagtttcattttcccaagttagctcaatgtagcatatcactccatcaataccttacttttttattgactagaaatttctcaataccctttcaatagtatccactaaaagagtcaggcgcagctaaatctcaacaaaaaaacaccacatattatttaacttatacgtaataatactagggactgtctgaa

SEQ ID NO: 172 - DNA, 325 bp, Lactobacillus plantarum
atgttagaaaatgttagaaatcaaaaacgggataatgctaacaattgctaacctaaaagctgaataggggtttacagaagtttacaaaatgagcagtattgtgcagatcgaactaccttataaaatcttatgtggaactacctattaaaacctattattgctttgctatgtaaactgcttgtttctgctaatgcgtggaatgctcgttggattgattgtaggtcgaaaatttcgacttaccctgtacatagttggttacagagttaaaaaaagtgatcgctataattgatgcacgtctacaacctgacaaaacatgacattgttt

SEQ ID NO: 173 - DNA, 316 bp, Lactobacillus plantarum
ctccagtctcaagcctgtgagaggccacgggttgaagccgagcattgcctagccaccacaggctttagtggcaccgaacttagcacaatctatcgttggctattttgatactggaactttaaacaaagcgttaggtgcactagcactttgtcgagagattaaatcttactattttgattcagaattagtgaattatctcaatatcattttcagtctgacagttgattgacaaaattatggtttatgaaaaacaatgacgaattcaccaaaagttgggtacgcacatgtccgccattcgaacactgtcccgactgga

SEQ ID NO: 174 - DNA, 301 bp, Lactobacillus plantarum
tccgttggcgtagcaagcacaaggttttagtggcaccgaacacgtttcgggaaaccgctcgaatggctgatgaacgaccacctaatttggtacaattagtcgctgactattttgatgctggaagtttaaacaaagcgctaggtacattaagaaatcctactacaccgattcaggattagtgagccatctcaatattattttcagtctgacagttgattaacaaaattatcgtttataaaaagcaacgacaaattcatcaaaagttggtgcatccatgtcagccattcgaatactgtcccga

SEQ ID NO: 175 - DNA, 2927755 bp, Lactobacillus plantarum (residues 1-1,463,878 of 2,927,755)
  misc_feature (81804)..(81813): n is a, c, g, or t
  misc_feature (86604)..(86613): n is a, c, g, or t
  misc_feature (88169)..(88178): n is a, c, g, or t
  misc_feature (163816)..(163825): n is a, c, g, or t
  misc_feature (183102)..(183111): n is a, c, g, or t
  misc_feature (199499)..(199508): n is a, c, g, or t
  misc_feature (249705)..(249714): n is a, c, g, or t
  misc_feature (274462)..(274471): n is a, c, g, or t
  misc_feature (275771)..(275780): n is a, c, g, or t
  misc_feature (294692)..(294701): n is a, c, g, or t
  misc_feature (295555)..(295564): n is a, c, g, or t
  misc_feature (327040)..(327049): n is a, c, g, or t
  misc_feature (332210)..(332219): n is a, c, g, or t
  misc_feature (354161)..(354170): n is a, c, g, or t
  misc_feature (356621)..(356630): n is a, c, g, or t
  misc_feature (387908)..(387917): n is a, c, g, or t
  misc_feature (394790)..(394799): n is a, c, g, or t
  misc_feature (429493)..(429502): n is a, c, g, or t
  misc_feature (468182)..(468191): n is a, c, g, or t
  misc_feature (507905)..(507914): n is a, c, g, or t
  misc_feature (514682)..(514691): n is a, c, g, or t
  misc_feature (556854)..(556863): n is a, c, g, or t
  misc_feature (668163)..(668172): n is a, c, g, or t
  misc_feature (742413)..(742422): n is a, c, g, or t
  misc_feature (749912)..(749921): n is a, c, g, or t
  misc_feature (752014)..(752023): n is a, c, g, or t
  misc_feature (769413)..(769422): n is a, c, g, or t
  misc_feature (809663)..(809672): n is a, c, g, or t
  misc_feature (813524)..(813533): n is a, c, g, or t
  misc_feature (889151)..(889160): n is a, c, g, or t
  misc_feature (927365)..(927374): n is a, c, g, or t
  misc_feature (928476)..(928485): n is a, c, g, or t
  misc_feature (967853)..(967862): n is a, c, g, or t
  misc_feature (1009021)..(1009030): n is a, c, g, or t
  misc_feature (1016016)..(1016025): n is a, c, g, or t
  misc_feature (1016968)..(1016977): n is a, c, g, or t
  misc_feature (1029530)..(1029539): n is a, c, g, or t
  misc_feature (1062103)..(1062112): n is a, c, g, or t
  misc_feature (1079287)..(1079296): n is a, c, g, or t
  misc_feature (1086209)..(1086218): n is a, c, g, or t
  misc_feature (1146586)..(1146595): n is a, c, g, or t
  misc_feature (1154707)..(1154716): n is a, c, g, or t
  misc_feature (1185653)..(1185662): n is a, c, g, or t
  misc_feature (1300383)..(1300392): n is a, c, g, or t
  misc_feature (1413091)..(1413100): n is a, c, g, or t
  misc_feature (1450241)..(1450250): n is a, c, g, or t
  misc_feature (1484619)..(1484628): n is a, c, g, or t
  misc_feature (1488523)..(1488532): n is a, c, g, or t
  misc_feature (1503073)..(1503082): n is a, c, g, or t
  misc_feature (1507790)..(1507799): n is a, c, g, or t
  misc_feature (1562182)..(1562191): n is a, c, g, or t
  misc_feature (1608761)..(1608770): n is a, c, g, or t
  misc_feature (1662111)..(1662120): n is a, c, g, or t
  misc_feature (1720792)..(1720801): n is a, c, g, or t
  misc_feature (1784123)..(1784132): n is a, c, g, or t
  misc_feature (1785048)..(1785057): n is a, c, g, or t
  misc_feature (1838993)..(1839002): n is a, c, g, or t
  misc_feature (1860352)..(1860361): n is a, c, g, or t
  misc_feature (1861096)..(1861105): n is a, c, g, or t
  misc_feature (1911743)..(1911753): n is a, c, g, or t
  misc_feature (1928610)..(1928619): n is a, c, g, or t
  misc_feature (1983163)..(1983172): n is a, c, g, or t
  misc_feature (2032263)..(2032272): n is a, c, g, or t
  misc_feature (2083486)..(2083495): n is a, c, g, or t
  misc_feature (2098698)..(2098707): n is a, c, g, or t
  misc_feature (2114670)..(2114679): n is a, c, g, or t
  misc_feature (2135286)..(2135295): n is a, c, g, or t
  misc_feature (2145198)..(2145207): n is a, c, g, or t
  misc_feature (2146976)..(2146985): n is a, c, g, or t
  misc_feature (2150336)..(2150345): n is a, c, g, or t
  misc_feature (2167341)..(2167350): n is a, c, g, or t
  misc_feature (2172649)..(2172658): n is a, c, g, or t
  misc_feature (2323519)..(2323528): n is a, c, g, or t
  misc_feature (2330848)..(2330857): n is a, c, g, or t
  misc_feature (2358289)..(2358298): n is a, c, g, or t
  misc_feature (2374109)..(2374118): n is a, c, g, or t
  misc_feature (2424089)..(2424098): n is a, c, g, or t
  misc_feature (2438700)..(2438709): n is a, c, g, or t
  misc_feature (2478692)..(2478701): n is a, c, g, or t
  misc_feature (2483715)..(2483724): n is a, c, g, or t
  misc_feature (2486960)..(2486969): n is a, c, g, or t
  misc_feature (2522220)..(2522229): n is a, c, g, or t
  misc_feature (2527389)..(2527398): n is a, c, g, or t
  misc_feature (2538134)..(2538143): n is a, c, g, or t
  misc_feature (2556819)..(2556828): n is a, c, g, or t
  misc_feature (2562189)..(2562198): n is a, c, g, or t
  misc_feature (2572924)..(2572933): n is a, c, g, or t
  misc_feature (2573598)..(2573607): n is a, c, g, or t
  misc_feature (2628000)..(2628009): n is a, c, g, or t
  misc_feature (2645807)..(2645816): n is a, c, g, or t
  misc_feature (2647442)..(2647451): n is a, c, g, or t
  misc_feature (2659488)..(2659497): n is a, c, g, or t
  misc_feature (2681517)..(2681526): n is a, c, g, or t
  misc_feature (2692146)..(2692155): n is a, c, g, or t
  misc_feature (2742333)..(2742342): n is a, c, g, or t
  misc_feature (2762779)..(2762788): n is a, c, g, or t
  misc_feature (2771056)..(2771065): n is a, c, g, or t
  misc_feature (2776788)..(2776797): n is a, c, g, or t
  misc_feature (2785658)..(2785667): n is a, c, g, or t
  misc_feature (2802090)..(2802099): n is a, c, g, or t
  misc_feature (2806511)..(2806520): n is a, c, g, or t
  misc_feature (2807153)..(2807162): n is a, c, g, or t
  misc_feature (2820333)..(2820342): n is a, c, g, or t
  misc_feature (2823185)..(2823194): n is a, c, g, or t
  misc_feature (2842706)..(2842715): n is a, c, g, or t
  misc_feature (2867923)..(2867932): n is a, c, g, or t
  misc_feature (2870297)..(2870306): n is a, c, g, or t
  misc_feature (2873414)..(2873423): n is a, c, g, or t
  misc_feature (2885842)..(2885851): n is a, c, g, or t
  misc_feature (2895378)..(2895387): n is a, c, g, or t
  misc_feature (2906405)..(2906414): n is a, c, g, or t
gtgctggaacgtaatgacttatggaatctcattaagttctctatggaacaagatctgtccaagatcacgtttcaaacgtttgtcgaaccggcaaaaccactccaactcgataaagcccaaatgacgatcgaagtcccaacacaacttcatcgtgactattgggagaaaaacttggccgcaaagttcacggacattgcgatgcaagcgactaacgagcagattcggccggtcatgataacggaagaagaacgtcagcaacttacgagagacaaggactcgcaagtgactaccggtaacgttgcgggacaacaaccaacaaccgcaactacccccacatttatgcgggaaacgaaactcaacccgaaatacacttttgatactttcgtgatcggtaaaggcaatcaaatggcccatgccgctgcgttagttgtgtcggaagaacccggcaccatgtataatccgttgtttttctacgggggcgttggtctgggaaaaacccacctaatgcacgctatcggtaacaaattgttagaaaccgatccgactagtaacattaaatatgtgactagcgaatcttttacgaatgaattaattaatgccattcaaactaaaaaacaggaggcgttccgcgaagaatatcggaacgttgacctgttattagtcgacgacattcaattttttgccaataaggaagcaacccaagaagagttcttccatacatttaatgctttatatgaagatgataagcaaatcgtgcttacatccgatcgcttaccgaacgaaattccgcaactccaagatcgcctagtttctaggtttaagtggggattatccgttgatattaccccacctgatctcgagacgcggattgctattttgcgcaataaagccgatcttgaagggatcgaaatccctgacgatacgttaagttatatcgccggtcagatcgactcaaacgtgcgagaactcgaaggtgccttagcacgagtgcaggcatactcacgactgaataattcaccgattaccaccagtttagtggcggatgcattgaagagtttgcaccttagcagtaaactatcagaggtttcgattcccgtcattcaggaaaaagtcgccaagtacttccatgtaacaatggctgaccttaagggaaagaaacgcaataaacaaatcgtgattccacgtcaaattgccatgtatttatcacgcgaactgactgaaagttcacttccgcgcatcggtaacgagtttggtggtaaggaccatacgactgtgatccatgcgcatgataaaatcactaaggcactcaaaactgatgctgaattacaaaaagccgtgggtgatttgacaggccagctcaaatcttagtgtggataaaaaaggataactcaaaaagttttccacaacttatacacatgtggaaaacttgataacgccgagtctttactcggttttccacagtacccactgctctactattactacgaacttttattattaatatatatctagtgcccgtcgctagaataaagaggggattaacttatgaaattcacgatcaatcgatctgccttcatcaaagaattaaataacgtccaacgggccatttcttcaaaaacgaccattccaattttgactggtcttaaacttgacgttaatactgacgctattaccttaactggtagtgatgctgatatttctattgaaaccaccattccagcaagtgatgacaacaatacgttagtcgttgaagatgccggttcaatcgttttacctgcccgtttctttagtgaaatcgtaaaaaaattaccagaagacaccatgactgttaacgtggtcgacggttttcaaacacaaattacttcaggagccgcttcctttacaatcaacggcttagaccctgaaaactacccacacttacctgaaattgatacgactaataccatcacgttagctggggatgtacttaaagagttgattggtcagaccgttattgctgtttccaatcaggaaagtcggccaatcctgaccggggttcattttatcttagctaacggtgagttcttagcggtcgcaaccgattcacaccgcctaagtcaacgccggatcaagttgccagaagccaataatgccaattatgatgtaatcattcctggtaaaagtttgacagaattatctcggatgatcggcgacaataatcctgacgtgcagatgcggttatcagaaaaccaagtcctatttgtgctggggaatacgtccttctattctcgcttactcgaaggaaattatcccgacacgtcacggctgattcctaaagaatctaatacgactgttgaaatttcagcacccgcactttcagcagcaattgaacgggcatccctgttatcacacgaaagtcgcaataatgtggttcgcttctccgttaacccaacggacaaaacgattacgattttcggtaactcaccagatgtcggggaagtaacggaacaactacagcccactgatttgtcaggtgacgaacttgaaatttcgtttaacccagactacatgaaagaagcgttacgttcgtttgggcaagctatgatcaaaatctcattcacgatggcattgcgcccattcactttagtgccaactgaagaaggcgaaaactttattcagttgattacaccagttcgaacgttttaattagctgaataaatatacaattctaaataaaaggcccgcatttcaccgtgaaatgcgggccttttatgacggctaaaactagctaaagatggggcaatgaataggcaatagcgatgatgtaacttttgaagttttaacttatgcatattatattagctgctggtgaattgtcacgctaactatcgatgttgccctactaaaatcccaccatctgatgaaccccagtccttgcactcgttcgctacaaacgctcgctttcagataatgaatgctggctttagccaatttttataggtaaaaaacaagatattttattaaaatccgcaaaattagggaatttcagcaaatttacccctaggctagtatcccgatattaaaaagccctaaatcgtcttaaaatggctctgagtgcggttataaattgaattttcatcaaaaaacaagtataatataacctgttaggagtgtgtgtagcacgccagacagtcgtttaatagcttgtaatcagataggcaggtgacattgtgaaacagccaatagatattaaaaccccatatatgacgttggggcaactcttaaaagaaacggccatcattggatcgggtggtcaggcgaagtggttcttaaaagaaacaaccgtgttagttaatggtgaaccagatgatcggcggggtcggaaactttatccaggcgatacgattgaagttgaagacaacgggtcattttttattcgctcaaatcaagaaacgactgattagatgtacttagaaaacttagtcttgcatgattttcggaactacgcggatttgaccattaattttagtcagggcgttaatgttctattaggtgaaaatgcgcagggaaagacgaacctgttggaagccatttatgtgttggcgttaacgcgtagtcaccgcaccgctaacgataaggaattaattcggtggcaaaccaccacggcaacgttgcaaggccggttacataaaagtaccggtgctgtccccctggaacttgaattggggcggcggggcaagcgagcgaaagtcaatcatcttgagcaagccaaattatcccagtacgtcggaaatttgaacgtgatcgtgtttgcacctgaagatttatccatcgttaaaggggcacccgcggttcgccgtcggtttatggatatggaatttggtcagatgagccctaaatacctctataacctaagtcagtatcgcacgattttaaaacaacgtaatcaatacttacggcaattaaatcggcagcaggccaaggataaggtttatttgggtgtcttgtcggatcaattggctgcatttggtgcggaaatcatccataaacgactacaactgttgcagcaacttgagaaatgggcgcaagctgttcacagcgagattacgcaagaacaggaacaattaacgtttcactatgtcactcaagtgccaactgccgaccagacgtcggtcgatcacatttatcaaacgctacaggccttatatcagcaacaacaagccaaagaaatttttcaaggaacgactttattaggtcctcatcgcgatgatttacaatttggtgttaacggcaaaaatgtgcagacttttggctcccaaggccaacaacgtacaactgctttgtccgttaagcttgctgaaattgatctgatgaaagctgagacgggcgagtacccggtcttattattagacgatgtcttatcagaattagacgctgcacggcagactcatctgctgacagcgatccaagataaagtgcagacctttttaaccacgccaagtcttgacggggtggcccgcaaattaattaatgcgccaaaagtatttgaagttagccatggcactttacatgaggaggaaccgcattgaccgaaaacgaaaaagaaaccaaacttgaacaggctcgcgaatatgatgctagtcaaattcaagttttggaaggtttagaagctgtccggaaacgtcccggaatgtatatcggtacgacgagtagccaaggactccaccacttagtttgggaaattgttgataacggaattgatgaagccctagcagggtttgcaaacgtgatccacgtgaccgttgaaaaggataatagtattacggttactgataacggtcgtgggattcctgttgatattcaagaaaaaacgggtaaaccagcgcttgaaacggtttatacgattttacatgccggtggtaaattcggtggtggcggttataaagtctctggtggtcttcacggggtcggggcttccgttgttaacgccttatcatcgaccctggacgtcaaagtaactcggaatggtcatgtttattacatggactttgaacgtggaaaggttaaaacaccgatgaagatcattggtgatgcgcctgatgatgctcatggtacggcggttcattttgttccggatcctgatattttccgggaaacgaccacctatgacattaatattttgacgactcggattcgcgaactcgctttcttaaataagggattacggatcacgattcgggataatcgccctgatgaacccactgaagatgactttctctacgaaggtgggattcgtcactatgttgaatatctagataagaataagaccgttctatttccagaaccgatttatgtggaaggggaacagaatgggattacggtagaagttgcgttgcaatatactgacgactaccacagtaatttgatgaccttcaccaacaatattcatacgtacgaaggtgggacgcatgaagaaggtttcaaacgtgctttgacgcgggtcatcaacgactatgctcgtaagaataacttgttgaaggaaagcgatgcgaacctatctggcgaagatgttcgtgaagggatgacggctgttgtcagcgtcaagcatccggatcctcaatttgaaggtcaaacgaagacgaaacttggtaattccgatgctcgggcagcagttgaccggttattctcagaacactttagcaagtacttgatggaaaacccaagtgttgcccgtaaagtggtcgataaagggttacttgcttccaaggcccgggtcgctgctaagcgtgcgcgggaagttacgcgaaaaaagagtggcttggaaattagtaatttaccaggtaagttggcggacaacagtagtaaagaccctgaaattagtgagttgttcattgtcgaaggggattctgccggtgggtcggctaagcagggacgttcccggttgacgcaagcgattttaccgattcggggtaaaattttgaacgttgaaaaggccagcattgataagattttagccaatgaagaaatccggtcattgtttacggcaatgggaactggcttcggtggtgacttcgacttgagcaaagccaattatcacaaattaattatcatgactgatgccgatgtcgatggggcccatattcggaccttgttattgacgttgttttaccggtacatgcggccattagttgacgctggctttgtgtacatcgctcaaccaccgttgtaccaagtccggcaaggtaaatttgtgaagtatattgattcagatgaagaattgagtgaggtcatggggcaattggcaccatcaccgaaaccagttgttcaacggtacaaggggcttggtgaaatggacgcggaacaattatgggaaacgaccatggatccagacaagcggcgcctattacgggttcgtgatgaagacgctgcggatgccgatggggtcttctcgatgttgatgggggaccaagtcaaaccacggcgagaatttattgaagataatgccaagttcgtccaggatctggatgtttagtgtgtcagtttagtcattttgacctaagaactgaggcgcaagctgttaatcagacttagggtcgtaatggcacgacggttgtcttaatggcgacttttacttgagacatgtaaagcttaatcaagctttaatagcggcaaaacggatgaaggaggacgaatattttggctgattcagatttatcgaacaatcgtatttcggatgtgaacctttcgaagaccatgcgaacgtcattcttaagctatgccatgagtgttatcgtggcacgggcactgccggacgtacgtgatgggttaaagccagtgcaccggcggattctttacggtatgagtgaattaggtgtgacgccggataagccgtataagaagtcggcccggattgttggggatgttatggggaagtatcatccccatggtgactccgcaatttatgagtcaatggtgcggatggcccaagactttagctatcgctacatgttagtggatggtcacgggaacttcggttctgtcgatggtgacggggctgccgcgatgcggtataccgaagcccggatgagtaagattgcggttgaaatgctccgcgatattaacaaggataccgttgattggcaaccaaactatgatgatacagaacgggaaccagcagtcttaccagcacgtttcccgaacttactcgttaacggtgccactgggattgctgttgggatgacaacaaacattccgccacataacttagcggaagtcatttcagcaatccacctgttgatggataatcctgatgcaacagttgctgacttgatggaagtcttacctggaccagattttccaactggcgggatcgtaatgggaaagtccggtattcgtaaggcttaccagactggtcgtgggaacattattgttcgtgcgaaggtcgatattcaagaccaaaagaatggtaagcaacgaattatcgtgaccgaattaccatatatggtcaataaagctaaattgatcgaacggattgctggtttagctcgagacaaggaaattgaaggtatcactgatatcaatgatgaaagtgaccgtgaagggatgcggatcgtcattgatgttcggcgggatgccagcgcctcggttatcttgaataacctttacaagatgacattgatgcagactaactttggctttaacatgttagccatcgttaagggtgctccaaaagtcttaagcttaaagcaaatcttaatctattacctggaacaccaggaagacgtgattcggcgtcggactgagtttgacttgaagaaagcccaagcacgggcccatattcttgaaggcttacggattgcccttgatcacattgatgaaatcattgcgattattcgtcaatcacaaacgagtgaaattgcgaagaaccaattgatggataattacggcttgtctgataagcaggcacaagccattcttgatatgcggttagtccggttaactggtttggaacgtgaaaagatcgagagtgaataccaggacttattgaaagccattgctgactacaaagaaatcttagctagcaaggatcgtatcaaccaaattatttacgaagaattaatggaaattcaacgtaagtttggtgataagcgtcggaccgaattgatggtcggtgaagtcctcagtattgaagatgaagacttgatcgaagaagaagaagtggctgttaccttaactcacaatggctacatcaaacggttaccaacgactgaatttaagtcgcaacaccgtggtggtcgtgggattcaagggatggacgtccatgatgatgactttattgaacatctcctgacgacgtcgacccatgatgtcctactctttttcactaatgcgggtaaagtttaccggatgaaggcttacgagattcctgaatacggtcgtacggccaaaggaatcccggtcatcaatttactgggagtcaattctggtgaaaaaattcaggcggtcgttaatgtcacgggcgatgcgagcgcttctgataactacctgttctttacaaccgttaaaggggttgtcaaacggacaccagttcaagaatttgccaatatccgtagcaatggtttgaaggccattacgcttaaggatgatgatgaattaatcggggttacaatcacggatggtcaccaaaatgtaatcatcgggacgcacgacggttatgccgtcagtttcgacgaaaccacagtgcggtccatgggccggacggcttctggggttcgcgggattcgcttacgcgatgatgactttgtgattggctttgacgttttgaagcccgacagcaacgtcttcatcatcacggaaaagggttatgggaaacaaacgccagctgccgattacccaattaaggggcgtggtggcaaaggaatcaagaccgctaacgtgactgagaagaatggtcatttagctggtttgacgacggttgatggtcaagaagatatcatggtaatgacgaaccaaggggtcatgattcgcttcaatatcgcaaccgtttctcagactggtcgggcaaccttaggtgttcgtctcatgcggttaggcgatgatggtcaagtcgcaacgatggccaaggttgatccagagccagaagttgatgagactgtcgcaacggatgcaacgactgaggcaccagttgacgatcaaaccgtcaatgccgatgccactacgacagaaccaacaactgattcaaacgattcaaacgaataaattgataaaacaagcgtggtcgacaagattgtcgaccacgcttgttttttatgtgagtcaagaattattatggcaacgggtcgtgtgtgatttaccggtcatcggtcctattctggcctccaaagtcttgttttgaaccggtagaaacaatcttcctgcgaagaataatttgactgctggaggctcatcacttagtcctgccatcttccagtgattggcagaaatgccgataaattgggagaggacaacatgaagtaagcaattttagatttacgcggtcaaaactggcttgtgcgattgagaggattacagcagtgcgtgttattctgacgtcgacttggtttaaattaatgctgtgtgggtgtggggaaatgtaagcgaaggggaggatttcagaaaaaagaaatatttcccgggaaataaaatgaaatatcgctcaattgacgtaattgattggtgtaacggattcaggatctttttgtaacagtcggccgcttcaacccttgcaacaaactgatttagatgctatactttaaattcgtgagtatctagcattagctagattactttccttgctcttcaaaaagaagggcctgaagtccataaggaggtgcaaatttcatgagtgaatcaaagaaatatgaaattacttacatcgtacgtcccgacatcgacgatgctgccaagacagccttagttgatcgtttcgacaaaatcttaactgataacggtgcgcaagtaattgattcaaaagactggtcaaagcgtcgtttcgcatacgaaatcggtggctttaacgaaggtacttaccatatcgttaacttaacagcaactgacgatgctgctttaaacgaattcgaccgtctttcaaagatcaatgatgacattttacgtcacatgatcgttaaacgcgaagactaatagacaaaattaattttaagagaggagcgcttctgcatgattaaccgtacaattcttgttggccgactgacaagagatccggaattacgttacacgaatggtggtgccgccgtcgcgacgttcactattgccgtaaaccgtcaattcacgaatcaaaatggggaacgtgaagcagatttcattagttgcgtcatttggcgtaaagctgctgaaaattttgcgaactttactcataaaggttcacttgttggtatcgatggccggattcaaacccggaactacgaaaaccaacaaggggtacgtgtttacgttacagaagttgtcgttgaaaacttctcattattagaatcacgggcagagtctgaacgtcatcagtctgccaatggtggtagtggtaataacaattacaacaacaataataatgggtatagtaatcaaggccaaaatgcggctcctcaacaatcatcagcgaataacaataacccatttggtaatggtaatactggtaatgctagcagtgcggcaccatcaagcagtgctaacaacaataatcaggctgacccattcgctaataatggcgatcaaattgatatctcggatgatgatttaccattctagtctaattgcttagacagataacgaggagggaaatatcaatggcacaacaaagaagaggtggccgtcgtcgtcgtaaagtcgacttcatcgccgcaaaccatatcgaatacatcgattataaagatactgacttattacgtcgctttatttcagaacgtgggaagattttgccacgtcgtgtaacggggactagtgctaagaaccaacgttctttaactatcgccatcaagcgtgcacggatcatgggcttattagcctttgtatctgaagactaatttttagtcattcaaaaaccacagacttcggctctgtggtttttatttacccttaacttgactagatagggtggtggccgttcaatgaagcgtttacggtgattgacacgaaacgctgaagcggacggtggtttgtgataaaatatagtcattactgagaaggcttgagggatttttaatatgaaaaagatcttttcgcgtgaaaaaattccatttttcctacaaaatcagcagttacgactcttagcgttggttatttttagcttgtcgttaattatgctcgtcactggttatttaatgaactggatttttgggaccgttgtcctcatcttgattgtgatggctgtggtgatatcttataatacgttgattgagctcagttcgagtgcaaatgaatatatctcagacttgtcgtatcgtattaagcgcggcgaacaagaggcactgattcagatgcctatcggagtaatgatttttaattccgaccagaccatcgaatggatcaatccttatcttcagcgctatttcggtgataaggacgtcttaggataccgcttggaagatattgagccaacactggcagcgacgctgaacgctcatctggacgagcccgcgacgattcgttggcaagactaccagtttgatgtacgtgtccagcagagcactaatacggtctatatgatggatgtgaccaagtatgctgagctgacggatcaattcgaagatgaaaaactcgtgattggacaaatctttttggataattacgatgaaatcacccagtcgatgactgatacggatatttccaacctgaacaattacgtgaccaatgaattgtctaagtggacccagatgtttgggatgtacctgaagcgcttggatgatgatcacttcttcttgttgggctatgctagtagtttacgacgtgttgaagagaataagtttcgcattttagatcgaattcgggagtcgacttctaagcaaaatttcccactaacattgagtattgggattgcttatggtgaacggaacatgaacaatttggccgatttagcgcagagtaacatggaccttgccttggggcggggtggtgaccaagttgtggtgaagtctgaggacgaacctgctcgtttctacggtggtaaaaccaacccgatggaaaaacggacgcgggtacgggcccggatgatcagtcagacgttacaagagttaatgaatcaatctgaccagatctttgttcaggggcaccgccaaccagatatggatgccgttggggcctgtctcgggattcgccgaattgctgaaatgaatggtaaacagtgttggatcgtcttggatgagcaaaatgtgcattcagacattcagcgtttactggaccagttgaagtctgatgagaacatcgagtcagcgattatctcgccggaagaagcacttgagaaggccactgaccaaagtttattgattatggctgaccattctaagccaagtatttcaatgtcacaggccctttatgagcggctcgaaaatcgcgttatgattattgatcatcatcgacggggcgaagaatttccagaaaacccagttttggtttatattgaaccgtatgcttcgtcgacttgtgagctgattaccgagatgtttgaatatcaatcgcacgatgccgaaccaatcaataagattgaggcgaccgcaatgttgaccggaatcgttatcgatacgaagtcattttcattacgatcaggatcgcggacgtttgatgctgctagttatctacgatcagccggtgcggactcgttactcgttcaacaatttatgaaggagaacgttgatagttatctacaacgcaatcatctgattgaaaccgttgaatttgttaaccaggatatggcattatgtgttggtgaagatgatcaggtctatgacccagtaacggcggctcaagctgctgattcactattatctatgtctggtgtcgacgcatcattcgtgattacacgtcgtgaagatggacgggtcggaatttcggcacgatcacttggcgagatcaacgtacaagtttatatggaaaaattgggtggtggcggtcatttatcgaatgctgcaacccagattgaagggcagtcagttgaagccgtcaaacaatcgttgattgatttgttaacggcaactgatgagccgaccacagaatctaattaggagtgagtctaaatgcaagttatttttttgaatgatgtccgtggtaagggcaagcggggccaaatcaagaatgtcccggatggttacgcacagaactttttaattaaaaagggattggccaaggaagccactaaagcggcaatcaatacgttgaaggctgaacagaagtctgaagcagcacgtgccgctgaggaattagccgaagctaagcaagtcaagacagttttggaagctgatgaaacggttgttgaattgaaggccaaagctggtactgatggtcggttgtttgggtcaattcctagcaaacaaattgcaacggcgttagctgaccaataccaagttaagcttgataaacgtaagatcgaattaccagaaccaattcgggtattaggttacacaaacgtgcctgttaagttacatccagaagtaacggcgaaaattcgcgtgcacgttgtcgaaaagtaaaaggacggatcacaaatgaacaacgatgtgctggatcaaaccccaccacaaaatattgaagctgaaaaggcagtcttgggggctattttcttaaacagtgatgccctcgtggaagcgatggagtttgtcgaagcgcaagatttctatcggcgcgcacatcagatcatttttgccagcatggtgactttaaatgaccgtgacgaggctattgatgcggtgaccgttagtgatttattaacggcccaaaatcaattggatgatgttggtgggatgagttacattgctgaattagctgggtccgtaccgactgcggctaacgctggctactatgctaagattgtggcgcaaaaggcgacggtgcggcggttgatcaagacggccacggagattacgcaaaaggcctatacggaaaatgatgacgtgaccacgttattagatgacgcggaacgcgacattatgaacgtgtctgaacagcgtaatcagagtgggtttaagtcgatttcagatgtgttgaacgcgtcgattgaagaaattgaccgcttgtatcaaaatgatgatgacattaccggtttaccgactggttttgcggagctggataaaatgaccgccggcttacaaccggataatctgattattttggctgcccggccagccgttggtaagacagcctttgtcctgaatattgcccaaaatgtggcgactaaaacggatacgacagtggccattttcagtttggaaatgggtgccgaatccttagtcaaccggatgctgtgtgcagaaggtagtattgacgctgggcatttacggacggggcaactgaacgaagaagagtgggaacacttggtggttgccatggggagtttgtctaaagctagtatttttattgacgatacccccggaatcaagatgtcagaaatccgggccaaaagtcgccgcttagcgaaagagcaaggtaacctcggcttgattgtggtcgattatttgcaactgatcgaaggtagtaacacagaaagtcggcaacaggaagtttccgaaatttcgcggcaaatgaagaaactggctaaggaactaggtgttccagtcattgccttatcacagctatctcgtggtgttgaacagcgtcaagataagcggccagtgctttccgatattcgtgaatcgggttcaattgaacaagatgctgacatcgttgccttcctataccgggaagattattatgatcgcgaaggcggcgacgatgatgatggcggtaattttggtggcggtggtgactttaatggcggcgatccgcgggacgaagatgcttctgaggatgttggtgaagttgaagtgattatcgaaaagaaccgtgctggggcacggggaacggtcaaactattatttgtgaaaccatttaataagttctcctcagtctcttatgcgcaggatccccaagcttaattgcagtcggtcaataaatttgttatcaaattcctcttaaactaattaagaggaattttttgtttatcacgtgccgaggctacttgttttccgccaattggttgggctgatgcaccaatttggccgtgataataatgagttagtgagataaatgtccctgttattttaaataaactttgctatgatgaaaagtagacagatttaataatggtggtgatggcgtggcacaaaagcaactcattaaaacgccgtggctaattgccgggcagtttatgaataacattggtatgagtttcatttggccgttaacgacgatctacatgcacaatgtgttaggtaagtcgttgacggagactggaattgtcctgatgctcaattcagttgccaacgttttggcaagtacgattggtgggcgtatatttgatcgaggtaatccttatcacctgttactgatgggaatcacgttgaatggcctcgcgaactttgctctgatcttttttcatggatggccgtggtatccgatgttgttagtcgtgaccgggtttgctagtggctggctaaatacgatgtttaatgctttggctgccagtgtcccccgcgataaagtgcggcgaacgtttacgttgatgtatctcgctgccaatctcggagttgtcttcggcacgatgctggttggtatcgtgtatagcatggggatggccttgctattctcgatgaccacgagcctcttcgtgattttcttgattattgcattatttgaatacaatgtggattcgtcgaacgtgaccggggttgatccgcgccaaggacaagatgtgcacttgccacgggccaattttcacattgtctggaccttctttattagtttattcattatctggttgctatacgaacagtgggtcagcaatttatccgtctacatgacgaatttggggatgccgctgcggaattacagttttctatggacaatcaacgcgggcttactagtccttattcagagtattttaagtttgctggggaatcggattaaaaatttatataatcaatttttcttcggcatgctattcgtgggcttatcatttctatcacttgtgattgcgcatgattacccacactttatctttgccatgattttattgacgattggtgaagcaacttggtcaccagccatgccaacactagtgagtcagttatcaccagttagtgctaaggggcgttaccaaggactagtacaagccttttgtgcgttagggcgctcgctagggccgttatttggtggtgtgattatcgataattggtcttataaggtgctgtttttgttggcatttgtggttttattgatcgtgttggcagttaatatcggtgtcgttcactttaatttacgcaaggccgttaattatatgaagacggacgttcagaccgatgtttcacgtgaaacaaaataattagagaagttggtggcagtagtgaaagtgatacgaaaactaaaggctaaacgagtcgtgattaaagtcgggacaagcacgctagtttatccagatggatcgatcaacttacgggcaatcgatcaattagcctttgttattagcgcaatgcgacaccgtgggcgtgaagttgtcttggtttcgtcaggggctattggtgttggcttgaattatatgggactcaagcaacgtccaaaagcaattcctgaacaacaggcgattgcggcgattgggcaaactgaattgatttcgatttacaaagaacgtttcgccatttatgaacaaaaaattggccagttgttattaacacgtgatatctttgtttatcctaagagtcaccataatgtgttgaatacatttgaggcgctattaaaacaaaacgtggtcccaattgttaatgaaaatgatacggtcgcggtcgatgaattggatcatgaaacaaagttcggtgataacgatcaactatccgcaatcgtggccacgaatatcggggcggatttgttaatcatgctatccgacatcgatggcttttatgatggtaatcccaatgcggatgcccgagcccagttattagggcacattgagaaggttgatcaacatacttataagctagctggcggtagtggcagtcggtttggtactggtgggatggtcactaagctaaaagcggcagaacggatgatcgatgcgaatggtcaaatgattttagccaatggtgcggatcccacaattatttttcaaattttagcaggcgaaccagtcggaacgctattcggttaagttggggaggttatcaaaatggtagatttagaacagttgggtcagcaggctcaacaagctagctatacgctggggttactttcaacggcgcaaaaaaatcaagtgttgaccgcaatggcaacggcgttaacgagccatcaagatgagatattggcagctaatgcgcaggatttagagaacccgcaagtaccagttaagtttgttgaccggctccggctaacagcagaccgcatccaggatatggcgaccggactcaaacaggtcgtgagtttgccagatccaattggaaatgtggaccgcgcgtggcgcaacgaggccgggttgatgattgccaaggaacgggtaccactaggtgttatcggcatgatttttgaagcgcgccccaatgtgacggtggatgcatcagcactgtgttttaaaaccggaaacgctgtaatcttacgtggtggtaaggaagcccttcactctaatcaagcacttgtccaagtcttacgtggtgcattacgggccgaagcggtcgatgagaatgcgattcaactgattacggatacgtcgcatgcgactgcggctaagttcatgcagctcactgattacgtggacgtcttaattccacgcgggagcgcccgtttgattcaaacggtgttggctaaagcaacggtacccgttattgaaacaggagccggtaattgtcacgtatatgtggacaaagacgcgcaattgcaaatggcaaccgatatcgtgatcaatgggaaagttcagcgaccatcggtttgcaacgccactgaaaagcttctaattcatcgtgaggttgcggccgattatttacctagcatgattcaggcacttcgtgaacaaggcgtagaagtacgcggggatgccgcaactcaagccattgttcctgatgtggttccagcaacggatgcggactggggaacggaatataatgatttaattattgcagtgaaagttgttgattcagaagcagcagccattacgcacatcaatcgttacaatacccaacattccgaagctattgtgacggataattatcaagctgggaagctcttccagcaacgggtcaacgcagcgtgtgtttatatcaatgcttccacccggtttacggatggctttgaatttgggtttggcgctgaaatcgggatttcaacgcagaagttacatgctcgcggtccgatgggattagcggaattaacatcttataaatatgtcattgatggcaatggtcagattcgccattgatgagcaagtatcgttattagtcattatatcggctaatagcgatttttttattgccgattggggggacaagtgtttatccgatttttgacttcttgatttgataacccaacatagccggtctagttttaagctcgcgtaccatacgtttggttcaaaagcagcaagctggtttcggcctgaatagtgaaggcacaataccatggtgacttagaatgttgagcgaaacttttagttgacagatgtaaacttaaaagctaatcttatcttaattagtttttaatctaaggggaggaatcatgatgatgaacgcaggattgcaaaacgttattgtagtcgtgaaaaccggtaattaccggtttaccacggataacggaggcttaccgttgatgtgttgttgtcggcgccaatcgaagtatcgttgccagtaaccgacatcatcgttaagttaggagtcatcattcatgaaaaaaagaatatggatcagcagtattggtattgtagccctaggattagtcttaactggctgcggtagccagcagagtagtcagcagaagacgttgaacgtaacggcgacccagtcgattgcgaccgctgatcctaataaggccgacgatatcgctagtcaggccgctattgctcagtttatggaaggcttgtatacaactaatcaaaaggggaaagtcgtgccggcaattgccaagaaagtcgtcaaaccgactaataatgggaagacttatacctttaatttgcggcacaatgccaagtggtcgaatggaaaaaaggtcacggccgctgactttgtttattccgtgcaacgccaggtcgatccgaataccaagtcacaggaagtcggacacgttgctgaaatcaagaatgcaacagcaatcacggctggtaagaaggcggtgaagaccttaggcgttaaagcgttgggtaagtataagttacaaattacattgcaacagcgcgtgccgtattttaattatcggctagccacagagatctatccgttaaacaaacaatttactgagaaatacgggaataagtatgggacatcggcacagcgaacgctctctaatggtccctatgtcttgaagagttggaatgggacgaatgacacgtggaaatatgtgaagaacccgtattattatgaccgtaaacaggtccgaatcaagaatattaaggtgcagacggtcaaaaataacagtacggccgagaacctcttccaaagcaatgaggtccaagtcacccagattacgggcacccaagtatcggcagctgagcaagggtcactaaaaagtcagatgaaggttacgaagttaaatcaactctacttcatgttgtggaaccagaagcgctcagcattgcagaatactgacttgcggcgtgctgtgagttacgctttgaatcgccagtcattggttaagaacgttctcaaagacggctcagtagcggcgacgtcattagttcctgctggcaataccaagaacccgacaacagggaaagattttaatacggataccggaaatttgtatccatacagtccagcaaaggctaaacagtattggcagaaggctcaggcgagcttaggaaagcaaaagttaacactgcaattattgacgaacgataatgatattaataagtcggtggcagaatatattcaagctgcaattgagaaaaatcttagtggtgtcacggtcaatgtcaagtcagtaccactgacaaatgagatttcaactttaagcaagggtgattttgactttgccacgttgtcgtggtcgagtgatttccaagatccagttgatttcttgaataaggcttcgataactaattctgtcaactttgggaagtttaacaatgcgaaatatgagcaattaatctcgacgattacggccgataagcagtcaactaaggcccgatatcagacgatgcagcaagcggctaagctagtcgctcagcaacagggggtcacaccgatttatcaaactgctgctgctcacttgatcagtaacaaggttggtggggttcacttcacattgttgcgagacgccctttatcgctatgcctactggaagtaatcagtcagataaatattattaatttgatagaaatgtaattgaataaatcaactagcccgaaaaaacgcgttttttcgggctttttttgatgttttggcaaacggcgcaataaaacggataaccacgggcttaactgtgaatagttgtcctgaatcagtttgcagcggtctgggtgactagtcataataatcgttatcttttaggggtttgtgccctgtttgatcactaagtaaggcgaccttatcaaggataggcaaacaccctgtcaccttcttataataagattaattttataatctgctcagttaatcacatagggggtgtgatgctttggttaaacaaactacggaaatgaatgatgcaagttacttatttaataccggcgcaggatttaatagtcaggattacttaggctgtcatttgggcgcatctggtcgggcggtatttcgcgtctgggcgccgcatgctaaggctgtcggggttgttggcgattttaatgactggcaaccaagcgcactaaagttattaggggcgacggggatttggcaaggacaagttccgaacgttcatgcgggtcagttatacaagtttcagatcacaacaccaactggccaagtgcaactaaagattgacccgtttgcacaacagttcgaacgaaaaccgggggatgcggccgtagttgttgagccgatgacgatgcgttggcacgatagtttgtggctagctcgccggaagaagtcgcgcgctgccaatcggccaattaacatttatgaggtgcacttaggttcgtggcgccgtcatcttgatggtagctactacacttatgcggaattagccgctgaactgattccctatgtaaaacaacggggctatacccacattgaattaatgcccgtgatggaacatttgttagatgcgtcttggggttatcagcaattagggtattttgcgccaaccagtcgttttggcaagcgtgacagttttctcagctttgttgaccagtgtcaccaagcgaatatcggggtattcgttgattgggtaccgggtcactttattcgcaattatgatgcgttgtaccagtatgatggtacgccgacatttgaatacgctgatcctgagcgcgcgaataaccgtcgttggggggcatggaattttgatctcggtaaaacacaggttcagagttttctgatttcaagcgccgaatattggctcgaccagtgtcatctagatggcttgcgagtggatgctgtctctaacatgttgtattgcgactatgatgaagggcgcgaagggcaggttaatcagtatggggataatcgtaatttagaaggcatcgcctttttacaaaagttgaacaccacggtcttaacccaccatcccgatatcttgatgattgcggaagagtcgtccgcctatccgcaggttacgggttcggtggccaatggcggattgggatttaactataagtggaacatggggtggatgcacgataccctggatttcttcatgatggatccgttatatcggcacgaccactttaatctactgacatttgcattcgtgtacatgttcgatgaacggtttattctaccgttttcacatgatgaagtcgtgcacggcaagaaatcattaatgcataaaatgccgggggaccgctataatcagtttgcaaatttgcggacgatgctaacttatatggctgccttcccaggaaaacaactgaattttatgggctcagagtgggggcagttcctagagtggcgggactggagtgcgttggaatgggtcgacttaaaggatgatctcaaccatcggatgcaacagttcacaacgcaactgaacgcggtctatcggcacaatcggccgttgtgggagcaggacgatgatcctgcggggattatttatacacataccgatgatcctgacagttcgaccatggggtttatccggcaggccaaacggaaatacagttttgtggtcgttgctttcaattttgttcctgttgaacgtcaagattaccgtatcggcgtaccgtatcgtggccgttatgagttgttactcaacactgaagcgcaggcttttggcggcacgtggacaaagctagaaacaacgtttacggcggtcgataagccgtatcgggggcaaccagctagttttaccgtgaccttgccggcgatgggtgcattgttgattcgaccagttaaagtgatagggggagttaagcatgcaagatgaaatgttaggtattattttagcgggcggtcagggcacccggcttggtaagttgacgaaggatacggctaagcccgccgtgccattcggcggtcgttatcgaattattgattttacactcagcaactgtgctaactcgggtgtgaataccgttggggttatcacgcaatatcaacccctagaactgaatgcacatattggtagcggtgcgagctggggctttgatagcttaaatggtggggtgacggttttacaaccatactcgtctagtgaaggtgagaagttctttcaagggacggcgcacgccatttatcaaaatatcgaatatattgatcaacaagaccccaagtacctgctcgtcttatctggcgatcatatttataagatggattatgacgctatgctgaaatatcatcaggagaagaaggcttcgttgaccgttggggtgatccacgtgactaacgaagaagccaaacgctttggcatgatgaatacggatgcgacggatcgaatcattgagtttgaggaaaaaccggaacatcctaagagtgataaagcctcgatgggcatttatatcttcaattggccgactttgcgggattacttagttaagagttatgctaccgataagtcacttgaagactttggtaaaaatgtcattccatcatacttagccaataatgaatccgtttacgcttatgcttttaagggttactggcgagatgttggaacgattaagagtctgtggcaagccaatatggaattcctatcgccccataaccggttaaatatcggcgatcgttactggcggatttactctaaagcagaggtgctaccaccgatgtttttgacggaaacgagccaggtcaataatgccatggtcgttgatagttgttacgttgcgggcgaaattgatcattcaatcttatcgcaacgcgtgtcagttgggatgggtagtcgcgtggttgacagtatgattatgcccggtgcaacgattggaaaaaatgtggtgattgaccacgcattgattggcgaagatgcagtgattggtgatgatgcccagattattggtacgactgataagattgcagttgttgggtatcacgaaacgatgggggtggaacaaccatgagacgtgaacaagtgagtgccattattaatttactggaaccaagtgacgcgttacaaccattgactgcagttcggccagttggaatgttaccctttggtggtcgttatcggttggttgattttcaattatcgagtgtcatcaatgcggggattcaaaatgtgatggtgacggtcccgcggtcagggcgttccgtggctgatcatttgcgtagtgggcgtgactggagcctgaacacaattcgcggcggcctattcttgtccccatacaatgacttgaaattagtggcgccagaaaagaaggccgcattactgcaccattactatgataattcgattcagtttctgaaatgcagccagagtgagtactcggtagtgatgagtactcgcaatgttggtaatattgatttaaaggcgctactacggtatcacgaggaacgtaacagtcccgtgacggcggtttataagcgcgttgatccagctagtttgattcccgaaaatacaatcttacaattgactgctaagggagaagcaacggcggtcgttccgatgagcaaggccaagattagcccgaagacgaaacaagttgccaagagcatggctatttacttgatgagtacggtcgatttaatcgaattattgcagtcggccaatcaacggggtgacatgatcagcctagaggaattgatgcggcaagcagtcatccaacataacgctaatgcttttgaatatacgggctttcaggcgaatattcatgatatcaacagctactttgcggccaatatggccgttttggatgaagctaatttccgagcgttattctacagttcgcgccgtatttacaccaaggtcaaaaatgaaatctcgacgttctttgcgactggttcacagtgtcgtgatagtttatgtggtactgggggctatattgaagggcaacttgaccactccgtcatctttcgggatgtactgattaatcgtgatagccaagttaaaaatgccatcattatgcagggggcccggatcggtgccggttgtaagttagaaaacgtcattatcgataaagacgccgtaatcgggcccaacctagtgcttaaaggaacttcaacgacaccgttagtcatcagcaaagggcagcacgtctttcaacaagcggaggtggctgtgcatgactagggtattattcgcggcggcagaagcggcccctttttataagactggtggcttaggcgatgttagtatggcgttaccgcgcgccttgcaagcggaaggaattgagacgcgtgtagtgattccgtattaccctcaccagatgccgaccgaatatcagcagcagttagtgccagtgacgcattttactgttcaagtgggtgaacatgcgatgtattgcggtattaaaactctgacagtcgcgcacgttcagtattatctaattgataatttagattattttggccgtgaaggattatatggttattgggatgatggtgaacgctttgccttctttcaaatggccgtttgtgaaatgatggagcggatcgattatatccctgatattttacaactcaatgattggcatacagcgtttattcctgtcttgctagctgaaaagtactattggatcgaagcgtatcgtgatattaaaacggcgctgacgattcataacttacagtttcaaggtgtctacgatccaattattttggatagtctctttcgaatcggaactgagacctacaccgaagccggcgtggcgttttacgatcaagtgaactggctgaagggcggtattaactttgcagatgccgttaatacggtgtcaccgacctacgcacaagagattcaaacaccagcttttggggaacgtctcgacggggtactgcgggccaatcggtacaaactgagtgggattcttaatggcattgatatgcaattatacgatcccgcaaccgacctggcactaacggcgaattattcggctaagaatttgaaacctaagcgtcagaataaacgtgctttacagcgccgattagggttgcctgtcaaaaacgtgccggtattggcagtcgtttctcggttaacgaagcaaaagggtatcgacctcttgctggatgcattgaatccattcttgcagcaacaagatgtgcaactcattgttttgggaacgggtgacccagcattggaacgcgcgttacgcacctatcagtcggcgtatccgcaaaaggtggtcgccgcgattcaatttgatacgcagctagctcagcaaatctatgcggccagtgatatctttcttatgccttctgcctttgaaccgtgtggcttgtcgcagatgatggcgatgcattacgggacgttaccgatcgtgcacgcggtcggtgggttgcgggacacggtcattccgtacaatcgctataccgatcagggaaccggctttagctttgacgactaccagccagcggttctacgtaaaattatggttctagccgtgaccttatatcggcagcatccactggtttggcggcagctgcagcaccaagcaatgacttgtgattttggctgggaacattctgcacagcagtaccgtgcgacttatcagaagctaatgcgttaggtttgatgggggtgtgaatttgaaattaacgtgtgcgcaatttaaaaaggactttctaagtgaaattgagaccttgtattcaacatcgctgagtgacacctcgacgattgggcaatttattgcactgggacagctagttcggcgctataacagtcagagttggacacgaacagctaaattttaccgcgatcatcatcagaaacaagtctattatttttccatcgagttcttgccgggacgcttactcgcttctaatttgttgaatctcaacttattgacgacggtaaaaaaagggctaacggaattaggcttagactttgagacaatcagtcaggctgaacctgatccggcgcttggtaacggaggattaggtcggttggcagcctgttatatggacgcgatggctagtttgaaaattgccggcaacggtaacggcatccgctatcgttacggcttgttcaaacaagttttcatggatggctatcaagtagaattacccgatgattggctccatcatggcaacgtgtgggagacccggcgcgataacaagagctgcattgtccagttcggcggcaatgtgtggttacaaccgcaatctgaaaatacggaagacgtgctagcggttccttacgacgttggtatcgtcgggtatcacaacgatattacgaacaccttgcgtttgtggtccgcggagttaccacccagtgcgacctattcttcgcaggatcagcgtgatcgaatcagtgagattaccaaggtcttgtatcctgacgattctaactcggccgggcaacaactgcgtttacgccaagaatactttttctcttctgcgggtgttcaaagtatcgtgcgtgatttttgtgcgacgcaccatggcatcaaattgttaggcaaaaaggtcgcgattcacattaacgatacgcacccgacgctggtgatccctgagatgatgcggctattaatggatgaacatcactgttcatgggaagttgcgtggacgttaacgacgcaagtcatgagttacacgaaccatacgattttacaagaggccctcgagacttggccaatcgatatgtttaaaaacctgctacctcggatttatcagattattgcggaaatcgaccggcgctaccgggaacaacaaacgccgatttttggcaaagcgctcgttgatcagacggcgcctttaggcaacggacaagtacggatggcctacctagctgtgattgggagtcacagtgtgaacggtgtcgcgccactgcatacggaattactgaaaacggatgtgttacggggcctgtatcaagtttatccggagcggtttaataataagacgaatggcattgcaacccggcggtgggttcaattggcgaaccaaccactagcgcaactgattgatcagacgattggttcggactggcggcggcaaccagatttattacagacgctactgccgtatcaacaagatgaccactttttgtatcagttaggtcaagttaaactgactaacaagcaagctttagccgcgtacgttcagcgtactatggggatcaagattcgcaccgacgcgatttacgatgttcaaatcaaacggttgcatgcttataagcggcaactcctacacgtctttgaaatcttgcgcgagtattttgccattaaggatcatccgcaacagccagtcgtgccgcgagtacacattttcggtgccaaggcggctcctagttatcactatgccaaggcgattatcaaacttattaatgtcgtcgctgacatggtgaatcaggacccggcgattggtgatcggttaaagatcgtctttattccgaactacggggtctccattgccgaactgatcattcccgccgccgacgttagcgagcaggtttcaacggcctccaaagaagcgtcggggactagtaacatgaaactgatggccaacggtgcattatcattggcaacgtatgacggcgcgaatattgacattatgcaagcggcgggtgctgaaaatgaatatccgtttggacttaaggtcaatgaagtgtacgactattaccatcgcggcaactatcacgccgctgacttttacgatgctgatcctgaattaaaacggctcttagatagtttgattgatggcacgattccgggaattccaacggttggtcgggaaatctatgattcattactgcggtataacgatgaattctttgtcttagccgattaccgggcttatgtcacccaacaacagcagatcagtcgtgattttcaaaatcaacccacttggcaacagcgctcgttagccaacattgccgcttctggacactttgccgcggacttagcagtggcgcggtatgctgacgatatttggcaagtgccccacgaacgactgaattaagaaaggaagggtgacggatgcaggtaacgtataactcatttttacccacgtataagacgccctttggtgccgtgacccgccagacacccgttcaattcacaatcagtgttcagacagtaacgccggttaagcagattgatttatgcgtggctcatgatggtcagtgggatgatgaacaggccttaccgttacatccaatcagtcccacaatgtatacggccacgtttataccgacccaggttggcctgtacttctactattttcggattgaaacggcgaccatgaccgcttattatggttgcgttgatggtggttatggtggcccgggcgttcaatacgtcttgcgcgagcatgttcaaatgtatcaattgacaatcttgaaagcagtagaaacattgccacaatggtatcgtgaaggggttgcttatcagatctttgttgaccgcttcaataatggcaacgcggatggccacgttaatgcgcccaagccaaatagctttatttatggtcaactaacggatcgcccactatacgtgcgtgatgaacaccgggcgattttacgctgggatttttacggtggtaatttgcgcggtattagtgctaagattccatatttacagcgactcggtgtgacaattatttatctgacgccgatctttgaggccagcagtaatcatcggtatgatacgggtgactatctgaagattgatccggtcgtcggcgatttgacggactttgataacctggtcgcggccgtacaccgggccggtatgcgactgatcttagacggtgtttttaaccatgttggtgtggattctaagtatttcaatcaggcgggccattacccgacggttggggcaactcagtcgaccacgagtccgtactacccgtggttcacattcattcattatccccacgattacgatagctggtggggcatccgtgatctgccgacagttgataaagacgatccaacataccgcgattttatctttggtaaacccgattcggtcattgattattggacgcaacgcggtgtggatggctggcgcctagatgtcgcggatgagttgccagacgatttcattgctggaattcgacggacccttgaccgttatccggataaggttttgatcggtgaagtttgggaggatgcctctcataaattagcgtatgggatgcgccggcactacttagagggcggcggcttacaggctgtcatgaattatccgctccgccgcttgattattcacgttttaaacggcacgctaacaccggccgaatggtggcgtgaactaatgaccctcaaggaaaattatcccgctacgacgtttcgctttaacttcaataacatcggtagccatgatacgcccagaatcctgactatgttagccgaagatcgccaacgcctacgtttggccgtccaactactcttgacgcttccaggtgtaccgtgcctgtattacggtgatgaggcgttgatgatgggggggaaagaccctgataaccgtgcgttttatccgtggcaggacgcagatcaggcgcaagttcagtttgtcgctgactgggcgaattggcgtcaacggcacccgtggttaaacacagcccactttgtgccgttttacttggcagattatggcattggctacctttattggcaggctgatcaaaccgtgatggtgattgtcaatgtgactactgaaccgcgaaccatgacgagtcacgatttaaagttgagtggtgtgcccataaaattagcacaagcgattcaacgctgccttgtgacgcagacgctgggtggtgaacagttgcgccttattgaaaactttacctaaattttacaggaacttgatgattgttagtacggttcagccgtatagtataattgtactttttaatagcaccccgctattgattatgtattacgaagtactcatcgatccttaatgagacgtaggcacattagtgcgtggctttccttgattggccacgcatttttgtgcgcttataagcagaatgtctgcgttgttcagacgaggtgcttataataaaggtaaacactaaagcaccttttcggatggttttaaatagacgtcatcacgaaggtaattagtgtattggtggcgctggttattggccagtgactgattaattagggggtaattggttgtaccaagcagtagtgttttttgatttggatggaacgttaatgcaggacgataagacggttgcggccagtagtgtgcgggcaatccagcaattacgagctaaccacgtcctacccgtcattgccacgggtcgcaatgtattcgaagttcaagacgtgatgacaacgacggggatcgattcaatcgtcagtgcgaatgggagttacgtcgcgtatcaagggcagtttttgagtgcgcacgaactggataaggagcttttgaccgatattactcattttgccaatcgccaacagaatgcgctagcttattataataacgccggttttgcgttaagccatcgtgatgcattgacaaccagtaattatcgggcactcagacagacggcccgggtcgcaccgcacttttatgaacatcaacatattaatttcttactgacgtttgatccgttgaatgcggcgcaatatcggcagcgatatcgaggccgactacattttgttcgtaataatccgcgtgcgctggacactatgcaatggggcgtctccaaggcggttggaattcaggatatcttaaccaaggcgcatttaactaaggtaccgacctatgcgtttggtgatcaattaaatgatattgagatgttccgaatgatccagacaccgattgcaatgggcaatggtcatccgcaggtcaaacaactcgcgcggtacgtgaccgctgacaacatgcacggcgggattgcccaaggattgcaacattttgatttgatttgagaattgacagctagtctgataattataagcttccagtgagcagtccaactggtgagattagcgactggcttaaacaaaacaaaccggatttggtaaccatgacgtggtcgccaaatccggtttgttttgtgatgagtttaatggaaatacgttagtttagttgtgccttaatattggcgagtgtgagctgagtcgtatcggtaaaattgatatctgccgccgctaaaacggtcgggtcaccaataccgatggcagtttcgccagcgcctttgatcgattgtacgccagccgccgcgtcctcgacaccaatacagtcagctggattaaggcctaaaatctcagcaccgcgccgaaaaatctcgggatcaggtttaccgtgtttgagactagcggggtcgacggccttcgtaaagtagtcactaagaccgagtttacgtagcacaagcggagcattttttgatgctgaagcgagtgacaatgcgtagccagccgttgttaattcagtcaaaaaggcggtgatgcctggtagaatgttggctggggtcatttggttaacgagctgcaaataattggtgttcttttccgtagctagcgcttgtttttgggccggtgtgaagtcattttctcggtgcccttgagctagaatgaggttgagtgaatccatccgactgatacctttgagcgcgtcagctaattgatcattccaactgaccccgactttatcggcgatctggtgccaagcttggctatgaaaagtagatgtgtccgtgataacgccatcgaggtcaaagacaaatcccttgattgctgcaaatttaaccatgttgattgcctcctagattaatcggtataagtgacggaaagtggtttcttagcttgtaattggtaatgctgttttccaatcataatcgtgctgggttggtccgcagtgacggttacccgttgatgatcgataacgaaaacatagtgaacaccccgaaagagatgcttgaatttcaatgtttgccagtgttcaggtagccgtgggttcacctgtaagtgggcacctagtggattgaccccgccaaagttccgtgtcgtcaggtttaaggtcgcacacatgacgccgaggtgaatcccttcagcggtcgtcccaccttgaatgtcgtaatagtcggatgcgagggcctctgagaaaagcttccaggcgtcatcgtcattatcgtcaagctgattcaaaacggcgtaaacgatccgcgagagagtggaaccatgcgttgtgcgcgctaaatagtattgaatgttatgggtcagatactctttaggaagttgatatcccattttttcaataatcttctgaacagttgtgacatcgaagttataaaaggccatcaaggcgtctgcttgtttggccacttggtaagcatcgggtgtcttagactctgctttcaagatccggtccatccgggcgatgtcaccgtacttttgccggtaagcttgaaagtcaagcgtcggtaggttgaagtacccctcaaattgagcaatgattccccgacggttgatttcaagtgttaattgatgactgatcgtcgttaacgcttgctcagccgttgagtcaaattgtgcggcctgagctgccgcttgaaaagcagcttggggcatctgcgcccgaagcgtggtaatcgtgtcaaagagccacgcaaccatgatattggtataggcgttattcttcaatccagcggtcgtgctgtttggatagttttcatggaattcatctggtcccatgaccccactaatgttataacggccattagcttggtcataatctgctttactgatccaaaaggctgcgatcgatagcaacatttccataccgtaatgagttaagaaatcacggtcctgagtaacgtggtagtaaaaccagacgttgtaggcaatatctaacgagacgtgtcgctggagccggctattatctggatcccaggttttagtaatgggatttaagtgagtgaattgagattgttcatcacccttggatgctgattgccaggggtacatggctcccgcgtagccttctgcttcggcatttttacgcgccattggtagtcgccggtaacgataagctaagagttgtttggctagttccggtcggtgcaacgtgtagaatggtaaaatgaacatttcgtcccaaaagacgtgtccccggtaagcttctccgtggagcccccgagcaccaacggaagcgtctaattggccgctttcaattgcggcagcagaaacgaaactgtggtaaatattgacgcgcagtaagcgttggcttgtaatatcgccacggatcttaatatctgtggctcgccaagtcgcttcccaatagtccttgctagtggttaccgtattgtcaaaactggactggtcgagctcggcttggacgtgggtcaactggggatcactatggtcattactagttgcaatgacgacgttcttatcgaaggtatacgttttaccagcttctaccgccagtgaaacggtttgctgaacgccctgaggttgttgcgtgctattaaagttctcaattgcaggaacgtctgggctagttagtttggccccaatcgtgtaattgatatgtgatgatttggtctgaccagaaaggtagacggtattagcagccgtttcgatgcccatagtcttcagatgatgctgatcgaagacgttatagcggctaacgttgctattcacgacgctaccgtcgatttcggtatagatttgtagactacccgcaaagttgagtggggtgacttggtaacgaatgctgtaacggtgccaatcacgcatgttggcgactttctgcgaccggattctgagttgatgtccggaagcgagctgaatcaatttagtggtcgtcaagagtcccgttttcaaatcaaggctccgataagcatcttgtaaatcatgtttgttgagtgtaaagggagtctgatgatcaataccgaaagtcatgaacagtcgtggtggtttgatcatagaccccggcaacgtatgtcccaggataattgtccttgtcggcgtgactttccaaaaaggcgccccgtagaccaaaataaccgttaccaatggtcaacatggcttcttgaccattattacggacaccgtggtattggccgtagtaatccaaatgccattttaaataggcacttttagctttaactgcgactactagtccaagttgatcaacggcagcttggctaacgactgggatattaagcaaattagtcaaagctagcccgacatcaatgcgatcatagttgacaccgacgattgtgtctgagaatggataggacagtccgttttcaagaatagcagcatcgaattgaagtccggctaagcgaaccttgatgttctctagattttcaccaattgtttggtcagaattataggcaatcaggtaatgggccgttgcggcttgccccgatactggatgataagcgatatccatcgcgtcattttcaattcgcaatctaataagtttcataagtccacactccttagttcggtcattaaaaattgcaataagtaatcctaaatataaaaatattaaccataactacagcctagtctctttttacaagactcgcaaatattggtgatgaaagtaggggctgacgaggttgaaagtggcgttgttttcgaaggtgaatgaacaaagtgttctggcttgtgctgatgatacttggtctttgatgcacgtccggaatagtcggacgtgcttgcattaataactggtttgaaagtgatatcacgcttcgagccatgctagttgttgggtgaccaaagcacgaagcgccacaactagaatttgcgtagaatctagtcgtggcgcttcggttgtgtctttctgagaaggcccaatttgtaacggctaatctaagtgagcggggccgtcagtgggctgatcaacgagttcgagatggtcgatcgtcatcatctggcgaatcttgattgaacttgtctgaaacctgagaatgacggggtctttgtaatttagttgctgctgaaagtccgttagttcagcccgccaatcttgttcaaaaacgttggtaccgactaatgagagttttccccgaagcataattgacgcatagtctgacagttggtaatagaataaactcgcttgacgccagttttgaatgttctgcgttgttgaagtttgacgactagtatagaagtaaagttcttctaggctccgtttgataggtaagggactgagcgctaccatggtcggaaagccgtccgcatcaacagttgctaacgtgaagacgggggcggtttggatcatatgtagggctgcctgacgagtcgtgtgttgcatacttagtcacccctttacacctcagtatgcaggaatcatgggggaaagtcatacgttatgcacaccgttttcagcgattaaaaactagggatgtgatatacttaagccacttaacgcgtggaacgttatgattgattggcgctcccaaggttaacgatgttgttactgcagtcagttctgagaggacttatctaataatgaagaatggtacagtaaaatggttcaatgcggataaagggtttggttttattacgggtgaagacggtaccgatgtctttgttcatttttcagcgattcaaactgatggctttaaaaccttagatgaaggtcaaaaagtaacttatgatgaagaacagggcgatcgtggcccccaagcaacgaacgttcaaccacaatagtaactgttgggccgaaccattatcattaactggttcggtttttatttgaagtgacgggttgtcagctaaacaagaaagctaagtggtcggaatggattttgtagatgtttacggcattaagcatgagaattgtacgttagttgcacctgcgcgtgaatatcagcgggtcgttatttttatggacgcattgggccggcgttttgttgcaatgggaccggatccacaaccaactaaatatggaagtagtagccaacattggcatcaagcacagccgagtgcagctcctgaaggttatttccatattgatcaagaataaccctagcaattgagttacttagctacgctgatggtaaacattagatcgttagaaaaagccccagggacgtcacacgcactttgcgttgtgcttcctgaggcttttttgtaggaataaaaaaatcagctttcacggtggattatcacggcgtgaaaactgattagtgtggttatatgatgggcagtcaggggatcgaaccctggacccacggattaagagtccgttgctctgccagctgagctaactgcccataactcaacaaaaaatataatatcatgaattttgagttctgacaacactatttcgaaagttttttcgaaaaaagtgtttttttgagtaattaattggtgaaaacgattgcttgaactggcaaatgatttcccgggaaatactacggccacgcggattagcaatcaaagaaagccaactacatttgtgatatactaaaaccagtgttgaatttagtttcaaccaaccctgacacgagaaaggacctgttttctcgtaatatatcgcgaattaccctaaaaattgaaatgtaaacctgttttcccctaaggaggaagaatcgttatgaaaaaaatcttagtagttgatgatgaaaagcccatctctgatatcatgaaatttaatctgaccaaagaaggctatgaagttcacgttgcagctgacggagaggaagccttacaaaaagtggatgaagtccaccctgatttgattttgttagatttgatgttgcctaagatggatggcttggaagttgctcgacaagtacggaagaactatgatatgccaattatcatggtaacggcaaaggactctgaattagacaaggtgttgggcttggaactgggcgcggacgactatgtgaccaaaccgttctcaaaccgggaactcgtggctcgagtcaaagcaaatctacggcggcaaggtgcaccaagtgctcaaccagctgaagttgaagaaaattcagacattgaaattggcgatctggtgattcatccagaagcttatatggtttccaaacgcggtgaaaacatcgaattaacgcaccgtgaatttgaactgttacattacttagcccaacatatcggccaagtcatgacgcgggaacacttgttgcagacggtctggggctatgattactttggtgatgtccggacagttgatgtgaccgtgcggcggttacgtgaaaaagttgaagataacccgagtcatccaaaatggctggtgacgcggcggggcgtgggttactatctccgcaatcctgaaaatgagtagaggttgctaaaccgtgttgagatttaaacggaaaaatttttttaaaacaattaatttcaaaattgcgctcgtgtttgcccttctattattgattacgttggaaatcgtgggtgcaatctttgtgaaacagttggaatcaaagaacatccaggattttaaacagtcggtgcaaattccaacttatattgataattcgttgtccgaacaattgaccgtcagcagtacgcgcaaggccaacggccaaatcaagacgattttgtcgaactacaacaatacgaatgttgatgaaatccaagttgttgacagcaaaggaacaattcgtgggacgagtgatgttaatgatcagtcagtagttggacaaaaaacgaccgatcgaaacgtcaagaatgcgatctataataatcgaacttacactaaaagtacctatgacactcagaataatggacgctactacgtttcaatcgtgccgctatatagctccaattcagcgggtaatagcagtcagttagttggggtactgtatgtacgggcaaatatgaagtctgtctacagtacgattaacaacattatgggaatctttgtgattgcgtcacttgctgcgatggtcttgggactgggaattgcaatcattattgcccgggcaataactcgtccaatcgaagaaatgaagcagcagacgcaacgaattgcccgtggtgattatgcggggcaagtccgagtttatagcgatgatgagttgggccagttggctaaagccattaataacttgtcgattcgagtggaagaatcgcaagagtcgacagaagctgagcggcgccggttggatagtgtgctctcacacatgagtgatggcgtgattgccactgatcgccggggtaatattaccatcatcaatgaaacagcctcggactttatggatgttacggccgaaaaggcaatcggtaactcgattttagatattttgaaaatccgtgatgattattcattgcgtgatttgattgaaaatcaagatgaattgatgcttgatttttcttcgaacgagcgtgacctaatcttgaatgcctacttctcgttaattcaacgggagtctgggtttattagtgggttagtctgtgtgctccacgatgtcacggaacaacaaaagattgataatgaccggaaacaatttgtttcgaacgtgtctcatgaattacggacaccactgactagtttgcggagttatattgaagcactgagtgatggagcgtggaaggatcctgaagtggccccaggatttttgaaggtcactcaagaagaaaccgatcgtatgattcgaatgatcaatgaactcttaagtctatcacggatggactcagggaccacccgggtcgatatggaattggtcaatattaatgagatgttcaattacgtgcttgatcggtttgatatgatcttaaagaaggatgataatccagctaagtattacactattaagcgcgagtttaccaagcgtgatctgtgggttgaaattgataccgataaattcactcaagtattggataacattatgaataatgcgatcaagtattcacctgatggcggtgtcgtgacttgtcgcctgttagagacgcataaccaagtgatcattagtattagtgatcagggcttgggtatcccacgggccgacttaggacacgtctttgaccgattcttccgagtcgacaaggcgcggtcacgggcccaaggtgggacgggcctcggtttggcgatttcaaaagaagttgttcagatgctcggcggtcgtatttgggttgatagtgttgaaggtaaggggtctacgttctatatctccctgccatacgaaccttatgaggaggaggacctttgggatgacgactcacaagcttagacgctttatcttacccattttattgacgattctgatcttattgagcgtggttttatccatgtatatctggttgaatccgtcacgctatgagcatgaaagcaaggttagtacgacgtcatcgaactcttcgttgacaactcggacaatcgatgatatttatttaccgacacaattaattcacactaacagtcagggtggccaatccctgctgattaataaaaatgtcagcttagtcagtcaatttagtgagcagttacgcaaatgggatgcgcggagtatctctaaagttcgcattacgtcggcaaaaagctaccgtgcgctcttaaatggaactgattcgtacgtattgaactttcctgacagtattactgtcagtatgtttaatacggtcttcaagcaacatctcagtaattttcgctcctcggaatttagtcggatcgtgattccagtcaatgatacgaatcacatctactttttgaatgatgaccatcatgagatttatagtgttcggttgaagaaaaaatctctgtcgtcgttgaaaaaagttttggcagtcgacaaggtcaaacggattgctgtcaagatgacctatgaggataatacaacgtatattgattatccaaagcaagttacgatgcaacattatagctacttgatgagtaaagcggctgcgagtgagattgccaaccgattactagatgcggatggtaattcgaccgtttcagtgcataatcgcagtggtaaacaggagtatacaacgggtagttacaagcgcatgacggtggattctaagctaggaacagtgtatttcgaagattatagtgattcaggaaccacgcggaacctatcactgactaatcagctaaagaagagcttcaatttgttaactagtctcggtgtcccaatggataatatccgctactacggttttgacgcaacgagtaatagtgtcatttaccgaagctatgttgaagggttcccgatctttaatcagaccgaaaatggcgatgtccggattcagctcacttctaacgggttagaccgttactacttctcactgtacagtttgcaggtgccagtaccaactactggtcagaagcaagcggtgaccttaccgagttcgacaagtgtgttaaaacgtctgaaggccgctggttataaagacagtaaaattggcagtattgaacttggctacgaatggtcacagaacaagtcgtccaaactcgtgatcgacctgacgccgacgtattatgtctactataatggcacttggcggacatatacgtcgatgttaagtggatcttaggaggtggccgcatgaattttcggagaattgagtggattttcctactagcatttgttgttctagatatcttcttgggttttatgttcgtgcaaacgagctctaagtcgacacaaacgactggtgatacggcgaccacgataattcgtgaaatgcgcgcagataatattagctttaaaaacccggacacgagcgaagggacgggttactatattgcgggcagtaacgagagtggtctcaaacaattgttgagtcagttaactgaacagacagcccgggtgcaaagcggcggtaagctcgtgagcacactacgggcaaccaccactatcgatacccgcaatcctaaagcggacttgacgacgtttatgagtcagcggaccaatgtaatccatggaaccgagtacgtctatgatgcggatttgtcgtctaacggcgattacgtttttgttcaaaaggttgcggatggcgagatcatgactggcgctgggcaagtccacctatttgttaataaaaacaagcagctgacaagttatactcagacgtacgtcaatcacgtcaaaactttacgcgaaaaggctgttacgatcagtgaaaaaaaggccctggttgcgttgtatcaatataatcaggtggcaagtagttcccggatcgtttgggcaaagcttgggtattctcggttattgaaattgaaggatagtagtgtttacgtcccaacgtggatctttgcggtccggggtaagaatagttctaacgttacactgcaccgtatcaatgcctttactggttcttcaatgaagaacggtagtacggctagtgatacgagtagtttagatgcgacggtcggaatgatgtggaatgcaattgattagtgaaaaccagtttaacgactaggtgtcgttgtcgaataacgggtgctgtgaagaagggtgtttttcctaacaggcccgttttttggtgactagatttttgactagttgtgatacgccaatgtcgaggtggcatgacgtagcgtggattgctcagcgttgatgttcgcggtttcgtgtgagtttaatggccggtaaactagtgtgcgcatacacgacagtaaactagactaaccgcgtgatggcgatagtcgtggacgttaagtttgagcacttgcaggtggcttgcttttcaaccccgctaaaagcgtgtatcatatgaagatagtaatggatttcagagataggaagagcctaaataatggtattaaaattagcaacggatgatatgaaagtaagcattctggcatcgggtagtacgggtaacgtgacatacatcgaaacgccagagcacaaagtattggttgatgcggggctaagtggcaaaaaaattgctaatttaatggcgtcgatcgatcgtgatattaatgaagtcgatagtttatttattagccatgaacacactgatcactgccattctgcggggattttagcgcggaagtatggtatggatgtttatgctaatcaggggacctgggacgcaatggcgcataaaatcggcaacgttcctgccgaattatgtcatgtctttgacccgaacacgacgcttggactaggtgatctcgacgtggaatcatttagtgtgtcacatgatgcggccgagccacaattttatgaactacatcatgccggaaaatcgtttgtcatcattacggatacgggctacgtttcagagcacgttgaaggtgtaatcaaagacgctgacggctatttatttgaatgtaatcatgacttagaaatgttgcggatgggtcggtatccatggccattaaagcagcgaattattggtgatgagggccatttatcgaatgaagatggtgcgaacgccttgatggatgtgattggccggcataccaagcggatttacttagggcatcgtagtcaggataataacttgaagtccttggcgcatttaacggttgcttccatgatgacggaacgagattttggcgttgagcatgattttcaattgtacgatacggagccagaacaagcgactaagttaattacgttataggttagctttaatgtttcacaacgcttcagtcataaaaaaatcacactttttcgctaaaataaacttaaaataagcattagtagggagggatcgcgtttcgacgcgcaattatggctaataaatcattaatcaaagtcgcagtaaccgcactagtagctggtttaatcggtggtggtgttgcttacggcggtattaattatttccaaaacaataacatcgcaacgtcatcgaccagtgtaccaactggttctaataaatcggggtcaacgtcaacgacgaacgttaaggtcaatgtcagttcacaggcgaccaaggtgtttgaaaataacaaggcggccgttgtatcggtcattaatctccaaaagaagagctcttcaagcagttggagtggtattttgggtggcgatgactcgtctggcagtgatagttcatccagttcagattctagctctagtaagctggaagagtacagtgaaggttctgggttgatctataagaagagcggtgacgcggcttatattgtaacgaataatcacgtggtgagtggttcaagtgccattcgagtgattatgagtgatgggactaagttgtcagctaaaattgtcggaaccgattctgtgactgacttggccgttctgaaaatcaattcttctaaagtaacgaagacggctagctttggtaactcagataatatcaaggttggtgaaacggccttagccattgggtcaccgatgggctctaattacgcaacgaccttgacgcaaggaatcatttcagcgaagaagcggaccgtggcaacgacgaatacatctggtcaaacgacggggtacgcgacggttatccaaacagatacggcaattaactctggaaactctggtggtccgttgttcaacattgctggacaagttatcggaatcaactcgatgaagttggcctcagataattctgggactagtgtcgaagggatgggctttgcaattccaagtaatgaagttgtgaagatcatcaatgaattggttcaaaagggtgaagtcgttcggccggctttaggggttgcaacctatgacctatccaatatttcttctagtgatcagaagtctgttcttaagttaccaaccagtgtgacgaagggtgtcgtcatcatgaagacgtactcaggttcaccggctaaagctgctgggttaacgaagtacgatgtgattacggagctaggtggcaagaaagtgaccagcttagccacgttacggagtgccctgtatgcccattcggttaatgataccgtgacggtgaaatactaccataacggaaaactcaagacagccaacatgaagttgacggaaactaccaaaacgttaactaaacaaagtaactaataaatgagaatttcataaacgtccctgactggataaagcagtcgggggcgtttttttaggttagtagccgaaattatgaaaaaacgaagaatcgattttcaataatcgactaaatttgcgaaagctggcaatggttgcgacaaaagccgaacaaactggttgaaatagcagaaagcatttattgtcgaatttgatggtgtgcaaaagtgtggacaactttggtgataaattttagtcgcgttagtcgaaatttatgaacagccggaaccatggggttgaagcttgtttaaaagttatccacaggcgccggactgtcctgtggatttaattttaaaaagttattttaataggcctcggttcttgatataataggatttgtaaccggaatccacgaacaagtgttgctgtgcaaaactgtggataagtcggaaaggtcttgacaaaacgaggctaaataaatattgtggcgaactggtgttcaacacaatatattgattattgagttatgcacctgtggataactatgttaataacttgtgtaaaggcggtcaattatgaacatcaaaattatctgtgtcgggaaattaaaagagaaatacttcaaacaggggattgcggaatatgcgaaaagaatgagtaaatttgcaaaattccagattgttgaagtgccagatgaaaaggctccagagtcattaagtaacgcagagatggaaaatgtgaaggccaaagagggccaacggatcctagaaaagatcaaggatcgcgattacgtatacgcgctagcaattttgggcaaagaacgctcgagtgaagaatttgcggcggaaattgataaactaacgacgtatggtcacagtgatattgatttcgtaatcggtggttcgctgggattatcaccggaagtgctgaagcgcgcggatactcagatttcgtttgggcgtttcacgttacctcaccaattaatgcggttagtgctgtcggagcaggtttatcgggcgtttatgattaatgtgggaagtccgtaccataagtgatgctaaaatttgtttttcaatagttacggatttattaggtgaataggaattctaatctgtttttgatggtcgtatttataacagtttagataaggctgcaaagaattacagttaccttactaaagtgtaagcagtatatagatatgcaattaccattaaataatggcgaaataaaaaaggacggtagcaacgatttttcagatgctgatattaaggctagattgaaatagcctggttatcactatactcaattgattgataatagcaaagtaagcggcaggtgctcctcaaaaaggcttgccgtttttgagtatacccaatccccaagatgctgattgtagattctcaggtatatatagctagtgattttttgcgtacaggtgccacatccataaaatttctaataattttaattgacatttattagggatagttttatattattaatcgaacgttcaatcgattaaaagagggtgccaaatatgcgggaaaaagatttagacaaagagaagagtattatcgatgaagtaagtcgtattattctaaaagagggaattgcggatgtttcgatgtccaaaattgccaaagcgagtggtatttcttcgtcaactatttacgtttatttttcagataaagaggatcttctaaaacaggtctaccttgctaaaaagcgacagttggcagcatttttaagtcaaaatatcaataccaaacccaataactcagttaagtttgtccaacagtttatgtatgcgttatacgatttcggcatgcaatattacgaagcattaatgattattgaacaattcaataattcgcccattcttgatagcttaaaaatcaaaaaggaggaatcctatcaaggtttcgagcaactttttgaagcagtcaaacatacacctgaatttgtcatttcttcaccagcagttattttaggttttgtttatgcaccaattgttttgtttgttaaagccttaaaaacacgtcaaattgataataagacaattatgatcgatcaagtggttgtgatgtgtatgaatgcactattgaaaaaataaaatatcagaacatgatatttttttgtctataattaaacgattgttcgattaaaaaggagagctatgatgactacaattaatgagatgcaccaaatttttaacttgcaaaagacacagtatgaccgtgcgcaaccaatgacctatgaagagcgtgtgactgttttaaatcagattgaggcattgattcgggataatatttcagaattaatcacggcacttcaagcagattttgggcagcgtgatccgctacaaattgtaagtgctgatttaaccggaccactagcgacgattgcatatattaagaagcatcttcgtaaatggatactaccagctaagcaacggtcgggtttgatggcattaactggaactaaacagtatgtttataatgaaccattgggtgtagttggtatcatgtcgccgtttaatgcaccaatcgatcttgcgctagatccagcggtagaagcgattgcagcggggaatcgagtgatggtaaagatctctgagtatacccctaagacagcggcactggtccagaaattgtcacaacagtatttaaatgaaaagaactttgcagtagtgacaggagaagctgatattgcggctcagttttcagcactggattgggacaaactagtttttacaggtggctctgaaactggtaagaaggtattatcggcggcggctcctaatttaacaccggttgttttagaactgggtggtaaaaatccagccgttgttttaccagatgctaacaagcaaatgacagctgccaagattgcgcgtagtcgttctggtaatagtggtcagatttgtttggacaccgattatgtgttacttcccactgaccagttggatgaatacgtgcgcttaatcactgcacaacttgcgcaagcatttccaacttacattaataattctgaatattctgccattatcaacgatcgttcttacgatcggattttgagaatgcttactgaagctcggcaacggggaactaggctgataacgattaatccaaataatgaattggttccggacgtgaaaagacggctaattccattaacgttggcgattaatcctgatcgagatttacagattgccagaaatgaaatttttggacctattttatcgatttttacgtatgattcacttgatgaagccatcgcttttattaactctcatgaaaagccgttagccatgtacttatttggtaggagttcaaggcatttgaatcaaattatttcgcagacatcatctggtggagtagatattaatgagttatccttgcatgcgggttcgcattcaatgggtttcggtggtgtgggttattctggaatgggacgctataaaggcggtaagacgggctttgagacgtttagtaatcaaaaatctgtgtataagcaaggtgttttggcaaaatatactacgcgcttaatggtgccgatccataataaacgtaatgaaaagctgctgaagcgaatgttgggactatgaagtcgtgtttaatctagggcaataacatggttaggacttttcttcgtgtctatgactaattgatgtaaaatactagtataagtatgaacattgattaggagttaatatggatctctacaaaataaatcaaagtaaaaatagtttaaataaggttagggtctcaagttttaatattgagcgtgaattacaagatttgattgaaaataatttagaattagttttagggattcaatttattgtcagtgaatttacagtaggtcattatcggttggatacagtggcgtatgatagtgaggttcgagctttcgtaatcattgaatataaacgaacgtctaaggatagcgtagttgatcagggcactgcctatttaaacacacttttgcaacataaagccgattttacgttagcctacaatgaaaagcttggtgcacgggcgcgagtggctgactttgactggacacaaacacgggttgtttttatcgctggtagttatactaattatcaaaaagatgctatcgataaccccaatttgccaattgagttatatgaggctaggaaaactgagaatggctatttgactctgcttcaaattatgaataatagtgaaaatagtcgttttgccaataaggttagtgcgttatcgtcacaatccaaagtaatctcgaaagcagcggatgttgatcaggtaagtgatttgaagccctatactgaggaaatgttcctagataaagctactgctaatatttgtgacttgtatgatgagcttaaagccgccattttgctgtgggattcagaatttgaagttaaaccgaccaaagtttacatcggactacgtattaaacatcataatgtggttgatttgttaccgcaaaaaagccagttaaaaatttggattaacttatcaaaaggagaactaaacgatcccaataatttattgagagatgttagcagtatcggccattggggaaatggagattatgaagtaattataaaagatgatactcagattgaatatattctgagcttaatcaaacaggcatgggaaaagtatcgtcactaaaactaaaaacgaatcgcaggtgcatctatatcacaacaatcaaagaaattactgaagctatcaaggctgatcccgataacgctgaatatacggcgaaggggtgggacccattatttcatgtgttaccgacagccactattttagtgattagtcaggcgccgggacgtattgcccaaaataccaagacgtatttcaatgatgcgagcggcgaccgacttcgagattggatgggcgtgacgcgggagcaattctatcaaagtgaccgcattgcagttatgccactagatttctactatcctggtaaaggcaaaagcggtgacttgccaccgcgcaagggcttcatggataaatggcatgaaccgctgctagcaatgatgcctaacgttcaactgacgttacttgtgggccaatatgcaattaaggcttatttaggacgttcacggcaaaagacgttgactgcaacggttcaaaattatcaggattacttgcctgattatttcccattagtgcatccatcgcccctaaattatggctggcaaaagaagaatccatggttccaagcgaccgtggtgccagatcttcaacgacgggtacagattgcattaaaataaggtctatgacagccttgttaaggccagtgttcatagcttgttgactgtaacttcaagggcctaatttggttaaaaacgtggtaatactgagcatgaatggctcggtattaccacgtttttagtttactggtttatgacgatgcgcttagctagccaagctttctcacttgaaaaaagatagtgctatcttttataatgatatttattctctttgttcatcactatttaaaatataggagctaaaaattcatggaaacaattaaagcgattcacacccggcattcagtccgggcttttaaagacgaccctattgagccacagttattaacaatgattgttacggatgctcagcaaaccccctcgtggggcaattcacaaccatggcaagtctatattgcaacggggcacgcactaactaatattaaacaacactatgctactgccgctgagtaagggattgcggaagacgctgatctcgccaaagtacaccggggtgatttttcggcgtttgctagccaaaatatggggcactgggtcggaacttttcggcccgtgatcgactcagacccgaccacttattgggatagtcgtgctaatctttatcgcgcaccggcgattgcctatctcgtactcaacgctaaccctaatagttggtcaatctatgatttaggcgctttttcgcagacgttaatgttggccgcaactgctcgcggagtacagtcagtaccatcttatgaattggttaaatatccggccattgtacgaaatgcactcgggatgcctgcgaataaagtagtggcgatggggattgctttaggctatgagaagcctgaaaaaccgttaaatcaatttcgaactgaccgagtttctacgccgcaagttttgcatattatcaactaatttagactcacttttgcagcagaaaaccagctgtttaccagcagacactattgccaaccgacaccgtttcatctaagatggagggtaacttgaacctgataggggaggctgggcaatgccgactaaacaacgaacgtacaaaattaagtcctatgtcaacgctagccatgcggtgcggtgggcaactggctccggaaaaaagcacacgcacacgtgggaaattgtttgtgaattgcacacggttgatgcgatggtcgctttttacgatattgaaaaaaacttgcatcaagcgttggatgaattgtcaggtaaatttttgaacgacttacctgaatttaaaactgttaatccaactgttgaaaatgtcacggagtatttatttaccaagattgataagacattgcgagacaacggggcgcaactgctgcgaattgaagttagtgattcgccaacacgcgcttattgtattagtgtcaccgaataagattaatgaaaggggccaccaagaacggcagttgcagctgttcttggtggccctgatttttatttaattatcgttttggacggacaactgctaaaaagtcagctaaagcctgcgggttggtcaattgtcgattacactgattgctgtcacgacaaatgtaattgccgttacgcgtgtaaggtccgagaccagatgacttggttgtcgacataaagagtgcgacgttgccaattgtttggcaaatggcacagacgcccttgactgtttgtggtgctaaatctccctggataccaatgagacgatcatgatccgggattactaaatactttttctggttaccaccatcattccaacctaggtaagtcaattcgtgtaatgctaattgtgaccatacaggctgcttcaactttttgaccttgcgaaacaacttgcttagttgctttgtcgtcaaggatggaaacggaataattagcggaattagcgtttcaagtagttgaggggccttggcacgggttagccggtccgtttgcaaatgggacaagaaattagcggtgattggattgtcactaggaagcagtggcgtaatccgctcgatagcttgtgcccgtacgacggctctaatttgaagatcgtttacggcgagctcggcgctaattaactgattgacttgctgagtaatataactgtattgataggtggtaattgtcggttgcataatataattcctttcagattcaaaccagacacttctctgaaaggttctgtcgaaaagtgtcgctaacgagcagcacttttgcgtacagataatgatgccatcatcattaatcatctccttattgtggccgattatagccacagcgataaacagtataacggatactgctgattttggcaatagatggtgtctgttttgataggcaccttgcataacttatatttggaaatcaaataccgtaagtcctaaaatgtttcacgtgaaactttcgccatgggacactaaaacatcacgcaactcgtgagttacgtgatgttctcaaatacatattcgctttgaattgtgcttaattcgtgactgaatctttgacttgtttcagcgcattttggaccgcttctttaatagctcggctagatgcagaggcacctgaaacggcgtcaacgctagtggagttggctgccacaatttcttgtggaatttgatcgatagcggttaaaccaacatcttcactttcatggtgttgaataacatcgactgcttgaattttatggtcgttgtaagtcacacgcacaataactttgccacctagcccggcattggaactgccgagatattgatcagcggccagtttaacattagatgctgtttcgccatcaacaaggtcattaattccgttggcttcgttggcggtgacagattcactatctacctttggacgagcagcgttttcaccggctaacttaccaaagatcaaacattcggctaaattaccaccaccttgatagcagtttgcaacgataccgcctaattcaccagcgccgaacaagcgtggaataggttcgtcattgacgttgagaatttgggcattttcattgcgttgtggccccccttgcgtgttgaggacgtcattggccgcagcaatggcatagtaagggccatcgtccagttgacgcatcgtttgcggatcacgaccaaattcaaaatcacgtcccacttctgtgtagtgattaaagtcagttaccgtctgttgtagattattagcaggaactcccaatttggcggccaattgtgcaatcgttggcgcggaaacgagcttggtcatgaatttcggatacggtaactgaccagcctgactttcttcttgtttgaaggcatcgtactgggtttgatcaaaaattaagtaggggtgctgattattcattgggattagccaagagccatgtgtgtaaacgtgtccgtgacggtgcttagcgtcttcttggaagtagcgtgtcccgtcatcagcgataacgaaaatactaccgttttttaataaaggccagtgttcaatttgacggccccgttcattggcgtcttctttgaaggtgattccaggtaagataccgtgagattcataattggtcatgtgccacattttggcatcaacttcttgagccattttgataccatcaccgcggttatagagcgtcccaagtggtgtcagatgatcactgtgcaagtaggtttgctttaactcaggattgttttcaaaaccacccatagctaaaacgacgccattattggcatggatattaagcagtcgctcgccccgtttgatttggaccccttggatcactttagtattaggatcttggatcaaatgttgtgcccgtgagtccaaccaaacgtcaatattgtcagctcgttcaaggactttttgccggagtagtttccataatgcagcgtctttatcacgtttgtgaacgagggcaaagtcaatcgtatcacttccggctagttctgggtattccgccatggttttcttgatggcaacggcatcaccgggtttaatatcatgtttccaactaacggctttaatccccagatatttttcaaaatatgctggaattttactcatgccgcttaaataggcgttgagtgtcttagtaggggtactgaatggcgcgcccagtgcttgataataagcggttagtttatctaagctttcacccgtaacgacgtgttgggcggagtagcgggtgttgccaccttcacggccaaatggtgccgcatcaactactagtacgtgggcaccattatcagcagcaaaacgagccgctgaagcaccggcaccaccaaagcctaaaacgatgacgtcgtagttaccgtgccagttcacattgagcgcgggcgtgccgttgagtgccttaacgtatttttcaaagttatcgaagcaccgttccaagaacttgatagaaggggcatcggtcatttgaccattctgatcaaaggctttagcagcgtagcttaacatgtattcattgccagggagtacctgagcatcaactccgggcgcattgagaatattgcgtaagtcaccttgagcacgacacgtcccctgtacgccaagggaagtaccaactaacatgaccggtttattagcaaaggggtggagctggtaagaaagccattcaataacgttcttgagtgcggccggaatggcatgatcgtattcgggtaccccgatgatcaccccatcggcctggctaattttatcatttaaggcttgaacggtcgccgggatatgattttgagttggttcattaaaaaggggaatccctgtaatttcattaacgtcaatggtagcccgttgactaaaatgatgcttcataaattgtaataattcacggttgtaagactgttgtgccgccgtaccaatcaaggcaatatatttcataattaacattcctttattagtttttagttggataagtatacgaattgtttacgctttcaatataaatagttacctagaaaaaacaaccgttaattttaacgaagccaacagaatgctattgtgacaaggataacaagctgtgattaatttgacgggttgtcgaaactttagtgagaattaagcaagtggcaaactttattttagctttttataaattctatttataaaagtgtccgataaaaggcactagtcgctatgataatttcaggtatttttaatcgcaaacaggtccctgtaggctgtatataacgggttttattgcgacacctcaagcaactacaactaaatttaaattgacagacttataaattaagttatggtgatattgaaaaacggcaaacaaccgttaatggcaagatatgtgaaaatcttaacaattatatgaagattaggaggaagtgcagatgttgagtgaaataaaatggaagggctttctgttaccgctaatttttggaattgggttatggctagttacgccactacgaccagtagcaattagtattatggcgtggcacttatttgcaatttttgtggcaacgattattgcttgtattaccaagccattaccgatgatggccgtcacgctgattgggattgttgtcgcgacgttaacgggtgtttttacgatggacgaagtcgctactggttttggtaattcgacggcgtggatggttgccatgtgcatgttcatggctgctggttttattaaatcaggacttggcaagcggatcgcctatctgtttgtcagtttatttggcaagcgcacgctgagcttagcatacgccttatcctttgttgatgccgtattggcgattggtattcctagcaataatgcgcgggtcaacgggattatgtatcccattattgataatctttctcgtgaaatgggatctgatccgaaacagggcacacagcgaaaattaggctcatttctagtttttaatgaatatgaagttaataatattacatcaggcttgtttttgaccggtttagctggcaacatggtggctattggtttagctaagatgcagggaatcacggtaacttggatgcaatggtttatggctgcttgtgtcccaggtattttatcgctactaattattccatgggtactatataaagtctatccccctgaggtgaaacaaacgccagacgcgcaccgctgggcaacgacgcgtttggccgcacttggaaaaatgacagctagtgaaaaaattatgtcaattacctttattttagcgattgttttatggttgatcgggactaaaattggcatcgatgcgaccgaagtaagttttatcgcagttgttattttgctgattacgggcgtgttaacgactaacgatttgctcaatgaacattttgcttggaatattttagtctggttatcgatcatcatgatgatgtctaagaagctaatgacactaggctttttcccatggttttccaaaacgttaggacatttactgaatggtatgaactggattagcgtgctcattatcctgtttttagcttatttttacttacattacatgtttccgagtgtttcaacacagatttcggcgttatatgctggctttttatccatcgccattggtgccggtgttccccatgttttagcggcgttactattggcatttgctggttcaatcaacttgtcaacgacgccgtactcggccgggcccgcggcattattgtcaagtacaggctatgtgactagtgcggagtggtggcgattgagtgcaattattggggttatttttaacgtcatctggttaggtgggggcttgctgtggaccaagttattaggcttttggtaagactaactgagcaatatagatgcggtaagtcgtgattgatcctgaccacgatttgccgcatctttcgtgttaaaattaggtattaaatagattgaatgggggcgttgacgtgaatgaacgcgatttaaagtacttctgttcattagttgagacgggaaattacacggccacggcgaccaagtttcacgtcacacaaccggctatttctgcagctttacgacgattggaagaagaataccaagcagtattactaacgcaggccaaccatcgggcccaactagtaacgacggcagcggggcggaccttgtatattaagtctaagcaactcttaaaagacgttgcgcagatggcactggaagttcatcacgctaatgagcagcaagttcggctcggattttccaatgttgcgggtggtatttggcttccccgggtgataaaaaaatttatctcagttgatttattagaccaggtcacaacgaccgttgctgattcagaacaattgttagttgacttgcggcaaggcaagttagacgcagcggttttttcaactttggtcccagaacgtgccacggatttacgggtgagcatcttagaggaacatcagatgcaggtcttggccaatgtcaatagtccattaagtcacttaaaaacgattcgagcaactgacttacaaggagtgcctatcatcgctcgtcctaaacacgcattaccacggttagcattagaacaatattgtcagcgcggccacatacagcctaaaatcgtctacgaggcagctaccaacgcgttagtcgaaggtctagttgctcaaaacgttggtgttggggtggtcattgcggattccgtagtgctaagtgatcaggttgtagggattccactagctgcccaagagcaattacactgttacatgcaactggcggtgcggaagtcctttttgcctaacgctaatcagcagcggtgcattgacgtcctacgtcaaattagacgggctaattaggtcttcagcactaatccaaaaatagcgctcgcattgactttttcagtcaacgcgagcgccgtcaaatcattattgagctaacattttttgagcgaattccttaacgagttcaatctgctcatctttgagcttgccgccagtactgccgatgattttcattcctttgccacccatgacttggtggaagtggccgatgacgggaatgcccttttcggtggcaatctttgtcagggctttgtctgaaaccatttctggtccgccagaagttgtgaatagggcgatttgtttgatcttagtcggatcaaggttcttcataaaagcagatgcggttttgtcgggtttcataaaataagtaccgccgccaaaaaagagtgtgtcagcttgttcgacaggtgtatcgatggattgtgctggaacacctgccacgctagcgatttgttcggcaaatgcttgtgtattgccattgcgagtttgataacgaattgctactgtcatggaaaagacctccgataaattagttgaaataagaccgttctcgcgatgagtaactgctcagggggactggttataagtttagaataatattgtaatatcaattctagtataaatcgttttgaaatcgattacaaaaatatagtgagcgcattcttgagggttaaggctagcttattcgattgctggaatagtcacagcaatctatcgcggttacgcgcatgacgatgttgtatcttaatggttattagcggagcaagcgggattcttgcgggcataatattggtgatgatacgcgattagtgtcgttatcgtcagtaatttaggaggacggcgaaatgccaaaaatatattttttatgtacgggcaatgcctgtcgcagtcagatggcagaaggctttgcacagcaattattgggaccaaactggcaagttgctagtgctggggtggagacacatggcctgaacccactagctgttcaagtaatgagcgaggtgggtattgatatcagtgaccaggtttctaaattaatcgacctgacctatcttaatcagtgtgcagtcgtggtgacgttgtgtggtgatgcacgggatcgctgccccgtcactccggcaacggtgaccaggctacactggccattgcctgatccggctcgcacgactggcagtgttagtgaccaattgctagtatttcgacaggtccgagatcagatcaaagcacgagtgattgatctggcacggaccttgaatgtttcggcaacgtagccgtgcacaatgaacggttgcagtattaagaaaataaatccaattataatgatgcgcatgtaagctaagaagggctggcatgcgtttttatgagctaattaaagttggaaccacactttagttagttataattgtgaaccaacacacatgtataaaagctacagtttaatcgtcgtaagactagtacttttatccattactcaaacaaatttagtgggttaatatgaaagcgtagtcaagataaatgaccggtcatcaggttaatatttactgataagttaataaaatcacaatttcatcgaggaggacgcaaaacatcatgaaagattttaaagataaagttatgtttatcacgggtgcggcccacggatttggtcaagttattgctgaaggcgccgcggatcggggtatgaagctcacgattgttgatatcgacgaaccagctttgaagaaaacgtaccaacatattctcgacaagggtgccgaggtgttgatggttaccgctgacgttacaaaggaagctagtgtcgacgatgcggttgagcaggccatggaaaagtttgggcggatcgacctactgattaataatgccgggatcgcgctacctggccgaatttgggaattgccgactcgtgattgggaatggatcatgcatatcaacttaatgagtcaagtttatgcgatgaagcgcgttatcccaattatgattcaacagaagacccatgcggatattcttaacgtggcttcgattgccggcttagttgatacgcccggaatgccttcttatcatgctagcaagttcgcttctgttgggatgactgaagcgaccgcctatgacttacaacgggctaatattgatatcgacatgcacgtgatgtgccctggctttgttcagacggatctctatcacactgaaaatcaccggccagcgcaatacagcgacccaacggacccgtattatcaaagtgaagcgtacttaaagggacaacaatttgcgaagtatgtcattaccaacgggaaaccaattgatacgattgccgataccgtctttaaagccttagaggataaccgtttctacattttgacccatccagaatataatccactgattgaagaccgagttaaacggatcgtgacggatggcgcaccagacgtgcacatcatggacggtatcatgtaagctaatcacgcaaacaaaggagtgttttaccatggcaagttttattgcaagtgatcaggatgttaagaactttttgacagcaccaagcatgaatgaccaggaaggtattgggtttgcttatgccactgacgaagcggtgcttaaggctttaattccagcaccattaaaattaatggcaccggtggtttgcggttatgtcgttcatatgggaaaaccgacttttagtgccccataccttgaagaaagcctatttgcgttagttagctacaaggataaaatgatgggcgcttacccgattaacctcttactccacggtcccggggcggagagtggtgtgattgcaggtcgggaaggtgctgggattcctaagaaattagcggatgacatcgaattgcgccggaatgacaacagtgcgacagccacggtcgaacgccatggcaagacattactgaacgtttcgtggacggccggtgaactgaatgatccgtcaattatgaaacaatttgcggggcagctcgcgttaggtaaggaagccgaaatgaatagtttcttctataaatatgacattgatcaacatgaagatgggacgaaccatttcagtaatgtccaattagttgcgactcaattacggtccttagctgatcaagttgaacctgggaacctaagtattcagttggagtcaaccgatgatgatccatttggcgaattgaaggtcttgaagccactcggtgccgcttggtttcacttcgacacgtcagttatgttcaacacactgaagttggacgaagttgatgctgcgacaacaatgccaaagctcttaacgggtcggtatgaccggagtttcttcaatcccaaggcagcgacttacattatttaggccgattacgaaagcgaggaatagctgatgtcagaagcagtaaaaaatttggtgaacaatgatttagcagacgtgatgtttaaccgccattcagttcggcagtttgacccgaacgttaaaattggacgtgatgagttacaaaagatgattgcggaagcagccaccgcgccatcggcatgtaatttacagtcatggcactttgtcgtcgtggatacccccgaggcaaaggctaagttcaaacaagccgtgatgaaattcaactacccacaggtcgacagtgcatcggccatcgtctttattgccggtgacacccagtcgcattatgtttatcgcgatgtctggaacaaagtttatgaggatgggaatattacgaaggaacgcttggatcagattctgggaaccttcttaccattatatgaaaatgccacaccagatttcttgaaattcgatgcgacgattgattgttccgttgtcgggatgcagttgctgctagtggcacgggctcatgggtatgatgccaatgcgttctccggaattgactttgaaaagatgattccgacgctgggtcttgatcctaaacgatacgtgccagtaatggggatcgcaatcgggaaagcagcgcaagaaccgctccatacgactcggtacgatgccaaaacacagactgatttcttagcctaataggtttatgaaaagagcgggattcccgctcttttttgtccgaatacgggcctaagaaagctgagggcctttcgagtggggtggtgggttgtcagtaggcctctttacaaaagcgcttacattatttatgatgaaggcgacaagcgtgaataaggaggttacttgagtatgcaattaaagccgttattgcggcagttagccacaacgtttgaggtgactgtcgatccaacatttacacataatcccgaagttactcacgtccaatttgttgatccgacggaagtgttagcaagccaccggttatatttgtcccccgactcgggtcagctagttcaacttgcttatagttggcacggccatcgtcagtcggtcggactagtaaatctgggaaccggtctgactacgatcattgcggcacaaaatcagttattgaaattattaatgacgcttggtcagtgcttacaccacgatgttcaaattcaagcagccatcaatcagctcgctatccaagcaatcacggcggattttgataccacactggcccaagcagtacacttattagagaatccgctggcgattattgatctgaacggggagattctgacacggtcgcatacgacgcaactcaatgggactagtattcacgctgcagttgagacgaatcgagtcggacgctggctgttagaccacggatttgcaccggatacgccggattttttaacgcaagtctatgtggcggaagatcagttgtcggcggggcccatgctaattacgccgttagcaaatggcaccgagccgatcggttatttggtgatgccagcactcaataaaccactgaatgatcgacaagcactactgatcaattcgattggtcaggttatcgctggctcgttagttaaaaatcagattatgccaacagctgaatcgcaacgggaccggttattaaacttattattgacggaacatcaagggggaacgtttgctgatcagtttgctgaacaacacgtgcaattaccgacagccatggtgttaatccgctgcgaaccactagctgatcaagcaccgatgattttacagcagcgactacagtacttgatgatgccacgattcaaacaagtgttggtttcgacttatcagcaacaatgtgtggcactgatcccaattagtctggtcgcatataatcagaatcaatttaaactaacgttgcagcaaattacgaagcaagcggattgccgcttgatcgtgtctcagcactacgttaatccggaagatacctttgccgcgtatacagtttgtgaacgaacggcgcaactgaagactggccgtggtcgggtgattttttgtgaagaccaattctataatcttgcgttggcacgagttaatcatcttgagatcttaccgttctttattaatccagccctacgtttgttgttagcctatgatcagcaaaaccatacagaactggtaccaacattagatgtctacttacgggcgacttgtaatttgacccgcacggctaagcaattatacgttcatccaaatacactgcgtaatcgactgcaccatatcacaacactgaccggatgcgatttacgggatgcggaaacgtgctttaaattggctgctagttttaaattacggcaatttttaacccagcatcagtaccagtatcgaccggatattccaattccgacccaagattaagcggggcataaaagcgtgcaaccgtttgtggaaaaatggttggaacagtcattattagtaaatccgtaaattcaggatggacggcagtaatggggccgccattgcgatttgatcggcgggcaggcgtgtgattggcaacaatcgtcattaaaatcgctatgcaaccggttgcattgaaactgaaagcgttttataatgttaagtgaacattaacggtgtgcttcaaaacaagacgggtagccgtcactcttggcgcatctattgatgattgcgcagttgtccggtacccagcaatcaattgtgctggtaattaacgaggaggaaccattaatgagtaaatttgcagatattaaagggtttgtatttgatttagatggcgtgattgcggatacgtccgtttatcactcacaagcttggcatcaattagctgacgagttgggcgttgcctggagtgaagaacttgccgataatttaaagggtgttagtcgaatggactcgttgaacttgatcttaaaaacgggtggtaaggaaaacgactatacggaagctgaaaaagtggcttacgcagccaagaaaaatactaattatctgaacctgttgaagggaatggataaaactgcaattttacctggtatcgaagacttcttagccgatctcgccaagcatgggtatcgtttatctttggcctcagcttctaagaattcaccattggttctggaacagttaggcttggcgcattactttgaagcccgggtggatcccgcaaccttgaaacacggtaagccagatccagagatcttcgaacgtggcgcggaagtgcttggcttgaagcctgaagaatgtgcgggcgttgaagatgctaaggtcggtattcagtcaattaatggtgctggtgaaacgtcgattgggattggtgatcctgccattttgacgggtgcggatgttaacttcacttcaacgagcgaattaaccttagctaatctaaaagccgcgttagcctaagtttaaataatacgaaaagcttacgtcacaaaatcaactagatttgtgatgcaagcttttttgagttactgcttttctgaaagtcttaatgggccactggcaaggtggcaatatcgggagtgagtaattggacgtgcggggtgcgactaagggcgtattctaacggaacggtctgtttttctaataaatgatcagttaagttaacttgctgaatcactcccggattttcgtacagttctagtgcgtacgtttgatgattcaagtccatgtagctacggtactcagtataggttgcttggccgttggcggctactttggcgcccttgggaatagtcacagcattcaagatgtgttgaagtaagttgactgtatctgttgttgtcgctggcacttgcgcatagtgtttcaagaagacggtccgtgcaaagcgagacatcgaagtatagttaccaggtagacctaatgcgcccgtaccaggtccctgtgaaccaggttggtagttaatgaatttatttagtggccgctcggtgttagtcagggtgccatacttacttaagttttgtagctgccatttgaggttcggtgaattggtcaggacgccgactgggttattaatcaggcgaagctcgccactagttggttccaagacggcggtttcaccggtttggtcactaatgataaagtgaagtggtggaatttcgttaattaattctgccgtgctactaatcaattgaacgtctttgacgcgctcacgtaagtcagcaacactagtgatttttccgagtacccaggcgacgaaatcgtggggtgcgagatcgattttgtcttggttactgtgaggctggtaaattgcatgattcggaaagtagagtgctgcgatgctgacaccacattcgttaacgccgtccgtgaaaatttcatggttcagttggcgacccgcgccaataaagccataagtcgtggtgaaatcaccaaggtcacccgtcacgcggtaatgtcgaggcatgaacataatacgggtctcaaagtcaacgttaaaatccattgtacgagctaagaagtggcctccatgactatttgtataagttagactagtgcacatacaaatcgctcctttattagatgatatcggtaacttatcatatgattgcggatagcggcgaaaattgtgacgcttaaattaacgaatggtaatcaagtttacttttgagggggtagttcaattaacaagctggggaaactcatcatgaggctaatgtttcacgtgaaacattatgcttttaaaatgacaaaatcgctatcataaatgatgttagtagcctaaaataagggggaaagctactaacataatgaacgatctaagacggaggaagaaatgaataaagagcgtaagtcggtgatgccactatcacaacgacatcatatgacaattccatggaaggactttatccgtaatgaagatgttcccgctaagcatgctagcttacaagagcgaacatcaattgttggtcgagttggcattttaatgttgtcgtgtgggacgggagcgtggcgggttcgtgatgcgatgaataagattgctcgcagcctgaatttaacgtgctcggcagatatcgggttgatttcgattcagtacacgtgttttcatcatgaacgtagttatacgcaagtattatcgataccaaatactggtgtaaatacggataaactaaatattcttgaacagtttgtcaaagactttgatgcgaaatatgcacggttaacggtggcacaagtgcatgcagcaattgatgaagttcagacgcgtcctaaacagtattcgccactggttcttgggttggcagctggcttagcctgtagtggatttatcttcttacttggtgggggtattcccgagatgatttgttcctttttgggcgcgggtcttggtaactatgttcgggcgctgatgggtaaacggtcgatgacgacggttgccgggattgcggtcagcgttgcggtggcgtgtttggcttatatggttagttttaagatttttgaatataatttccaaattcttgcccagcatgaggcggggtatattggtgccatgttattcgtgattccgggttttccgttcattacgagtatgttggatatctctaagttggatatgcgctcaggactggagcgcttagcttacgcgattatggttaccctgattgcaactctcgtcggatggctagtcgcgacactggtgagcttcaagccagctgatttcttaccgctaggactttcaccgttagcggtacttttattacgattaccagctagtttttgcggcgtttacgggttctcaataatgtttaatagttcgcaaaagatggccattaccgcgggatttattggggccattgcgaatacattgcgccttgaactagttgacttgacagcaatgccaccggccgcggccgccttttgtggggcgctcgttgccggcttgatcgcatcggtggttaatcgttataacggctatccccggatttcattgacggtaccttcaatcgtaattatggttccgggattatatatttatcgtgcaatttatagtattggcaataatcaaattggtgtcggttcactatggctgacgaaggccgtgttaatcatcatgtttttaccgctcgggctatttgtagcgcgtgcgttgttggatcacgaatggcgacactttgattaattgagtctatcaagttagcggttaaaaagtcatttagtcaccagctcagttaggtctggtgactaaatgactttttaaatggcctttgactgaaaatttaacggtgacagtttacaattaagttatcaatctagcagggggcttggtcatggaagggattactaatttacggtcactaggtggttatcgcaataaaaatcagcaagtaatcaaagatggtttaatttaccggtcaggacaattggatcaattaacaccggcacagacgcagtatctagcaaccacgcttggcattacgcgaatcgtggacatgcgtagtgctgatgagcgtcatcaatttccagatgcgacatggccacacgtccagtatcacgtgctggatgtgctagcacaagtcatgacgaacgacgcaagtttacaatcgatgattagtagtacgggggcggtccatgaccgcatggttcagttatatgaacagctagcgttagatcctactgcccgtcaaagttattgtcaatttatacagctactactggttccagatcagccactactgttccattgttttgccggtaaggatcgcaccggcgtcggggccgccttatttctaaaaattttgggtattagtgacgagcaaatcatggctgactatctgctcacaaatcaagcacgtgcagctgctaatcaacaaatcttggcgacgatggcgtcgcaattatctgatgagcaacaacgggccgtgaaccaggcattattagtagacgctgattacctgagccattactttgaagtcatcaaagcccggtacgacacattttcaaattacttgcagacgggtctagggctgacctcagcggaatgtcaacagttacgcgaattatatttgactaaatagtcaataatataaaggcgcaaaaaatcacaccaatactcacttaaggactaacctgggtattggtgtgattacttattcatgggtgtttgcgttgtccgctgacaatagtcggtcaatcatctgattgccagcctgtaaatcggcgcgttgataatgttgggcacgaatacgcattggatcaccaccatgatagtattcgtacatcaattggcgctgaccaaagccagaacttgttaaatcgaaggctaagttcaacaagcgcgtgcgggttttagcggtggctcggtccgtcgtgagtgcctggttgaggattgtcgcattatcgccgtcaaattccgcaaaacttggcacgccaactatggaaccggccgctaagtgttgagtcacgcgcaaggcctcgtcatagtattcgggaagggtcgagcgaaccgcttgcaaagcttggagactgggcgtatagataccgaattcgtccagatgaccgttgtcttctgaacgggtgatggtacccttgatgagttccagattagcggttaaccgaccgagtttttcttggacacctaagaaaccatctaatcctaagatatgagcaatccgaagcgctaaactggttgctaactcaagcttagtaatacctcgaacctcatcttgatgggaagtgtggctaaacatgcctgaatcgatgaagaaacgattactcatttcaacattattttcaacaaatacttttgaccacggaataaaggcgtgatcaaagacaatgtaggcgtcaatctcatcaagggcgttgctgagtgggtaatccgtaatggaagcggtgggatgatctaataatttgcgacaaatgatcttgacgcccggattattgagtggcgtagcaaaggcgacagcataactattatcgccgttttctaacaacagttccggcggattaaaaatcaggaggtcatcagcaattggggccatcgtattgaccattttggcaccagaaacgaagattccatcttgattacgttcaatggtatgaacacccgcgtatccagacggaatggcattgatggctttttgacggttgagttgtgggttttgaagcgcatggctaatgaagatatcgttagctttgacctccttagcgtaattgcgggcattagctgcaaaatcagtatattgattttgcccgaggaaggcagcgcgttctgctaagacggccatcccagtattaagaaaatccggtgtgcggcctaacatgccgctgttactttgcgcaatttcttgataagcacggtgcttttgttgtaaatcagcgacggtgcgtggcactttgaaagcaatatcgtagcggtgaccattttcctgataagtatgtacttcgggatggttgtgttgcaggtcatagtactgattattgagtgctaaagttttacgaaaaatgggcacatcggcgacattgacgcggtgaccatttagatagaccgcgcgtccgtcattgagttgttcgatagtatgcatgtgtcgttccccctaatgaaagttctattccaatataccactaatggaagcgaattcaccagtgctgattggaacgctatttttagtgaacgggataaacgacgtggaagcgttccagaaccatttgtgcagtatggggatcaaagcgctgatgctcgctttggtactcctgcttgaagaaggcatcatgaacacggcgccaataggcataagtacgatcgccttcaccttctaagtaagcgtgggttgcatcgatgtccaagtaaggcgtaatcatgacttgatcggtccgggtcacacagacaggctgattatgagcatctaagatgacgtcataagcgcccacttttggcagtggttcatcagtttcgtataggtcataagcgctggtggtagccgtttttgtgccagttagtacgagctgtgcaagtttatcaggatcgctgccaaactgataagcactttgtaatggggtactttgtgtcaatttgagcgtcgttttagcttgttcgaaaaaagattggacgtccattattatcacctctaaattatgatcggttttaagtttaacataagcgcccatggctcaagtaattagcgtggtataatgactctatcttgggtaattgcaggcgatacccagaccaaacattgccgttgtggaaaggactaatcatgcgaattaatgtgttgcaacatacccccaatgagggccctggaatgattgctgattgggcgcatgcccatggtcataccatgtatgtctatcacccgtatcaattcggtgttctcccaacggcggatgagacggagatgcttgttatcctcggcggaccgatgagtcccaacgatacgctgccatggatcaagcaggaacgagacttgattcaacaattattggaccgcgatatcccaatgtttggtgcgtgttacggcgcgcaacaaattgcgaagaccttaggatacccagtcactaaggcgccagctaaggaagtaggttgggcaccgatttaccgacagagtcccgtgattccggggattccagcaaaactgtcggtcttgcattggcacgaggagatgttcaccgttccaggcgaagcaacgctgttgttctctagtgatcgtgtgaccaatcagggcttcgtatggaagcatcgggtagtggggttacaatttcactttgagccggctgcggacaatgttcgtgagatggtcgtcaatgattatcggtatattgcggggtcggtcctaaaccaaacagcagcagaaattttacaaacgccggtaccacgagagaatcaacaagttctgaatgcaattttgaattatattacggctgaataaagcagttaagaagagaataatcaggttagtaaaaatatcggtagcccttgacggggctaccgacattttgttcagaaaaccaaacgttaatagaaatcttgaatttgctgcagttcttgcagataggcagtttttaacgcttccggataaataattctaacgttgcggccaagtcccagtaaatagtcgaccatataggctaattcatcttgattataaccaccaatgagataatcttggtcgttctgatgtgttaagtgcatattaggataattattcttttgtacatgttcacggcctagaggtgttagtgcacatttataacgtatattgtgatgatggtgatcgtaggaccgttgccgttgcgcgagctgtttccaagtataccgagctggttgctcactggtttgaaatgctttgatcgtatcacagcgatagatgccccaagcattgttatcgagattgacgccactgaaaaaccaaatgccatgccgatataataaatcaaaaatctgaaacccagctgtcacagtagtcatcgttaactggacaacattttcatcaaggatagccgttaataaatcacttaaatgggttggggcatccaagttaggaattgagtagtagttaaccacacgttgcaatttggcgacctggcgctggttgcttaaagatagtgttgccatgagttttttgtaaattgtatggtaggacttttcaaagggggtcgccgacaataaactgagtgctttgagcgcaaaaaagagcgcattaatttcctggctgtttaataagatgggtacccatagttgttgttgcatgatttggtagccaccgtaacgtcccggttcaacgtaaatggacaaaccaagttgttctaacgagttaacgtcgcgcaaggcggtccgtttggagatattgaattcttgcatgagttctttgatgtggaattcttgtcggtaactgagaaagatcaattcttgattaagacgttcagagcggttcatataaataactcctaaaaatgattttaatggtgacatggattggcacctttcgactgtagtatataactgttgtcaaaaacaaccaataaatagattattaattaaggagatatttaaatgactaagactttgattgttaatgcacatcccgattttcgtaatgcggcgcactactcagttcaactagaacaagcttttttgcaactttttcagactcgctttcctaatgatactgtggatgtgatcaatttgtatgatacggtgattccccaagcaacggtacctgaattgctgggaatctgggaaaagcaagcgcaacatgtaaatttatcgattgaggaacaacgcctgtttgcaatcaatcagcaactcctacaacagtttaaagctcatcatcggattgtgattgcgatgccgttgcataatttcaacgtgccggcacggttaaaggactatatcgataatatcttagttgccagggagacttttcgttataccgaaaatggatcagtgggtttgatgaccgataattatcgtgtcatgttactgcaggccagtgggtcaatctatactcgtaatgaccgttatacacccatggaattttctcggctgtatcttgacaagatgtttactgaaattatggggtttgaccggtttgagattgtccgtgcacaaggactgcaaacgaacggggtggcggtatcacaggcattaaagcaagccaaaatggacctgaaggcagcttttgagcgtttttatgattaagtctgaaaatgattttaaggtatcggtagttgtaggctacggataccttttttgcgatactgcacgggaaatgggtcaccactactttaaagtgatcgcaactatggaaagtaactagcctgattttggtgattaacattggactaaaacacgccaaaattcatgcatatttaacgttagtggcagacctttactagccgttcagtgctgagaaccggtatactggaagcagtgattcactaatcgtgaagggagcccaatatgaaacggattgtagcgggaattattgcccacgtcgatgccggtaaaacgacgctgtcagaagcattactataccggtctggcgcgctacggcaattagggcgcgtcgataatggcgatgcttttttagatacggatgtgcttgaaaaacagcgtggtattacgattttttcacaccaagctaatttacaatataaagacattaatttaacactcttggataccccgggccacgtcgattttgcgacccagactgaacaagtactgtcggttttggacgtcgcaattttagtcgtttcagcgactgatggtgtgcaggggtacacgcggacgttatggcgattattagcccgttatgacgttcctaccattctgtttgtaaataagatggatgcgccggggacggatagcgacaaattgatacaacaaattcaacagacattatcgcctggttgtgtggcgtttaacacgccgggagccggggacacgttggaagatcggccagtcataccgactgcggcagttgaagatattgcgatgcaaaatgacgaagtgttaacggattacttagaaacagggacgttaagtgatgccacgattcggcagatgattcaacggcgggaagtttttccgtgttattttggcgcggcacttaagctggacggggttgatgcgctaatggctggtcttgattattggacgacgccacaattaacgcgtcctgaatttggcgcgcgggtgttcaagattacgcacgatgatcaaggtgaacggcttacttggattcggatgaccggtggcaccttacgacctaaagatatcgtgtatgatgaccaaaaagtcaatcagttacgggtttacaacgggactaagtatgcgaccacgtccgcgctgacggcaggatccgttggtgccattaccggtctaacgggaacgcggccggggcaaggattgggacaggcagcaactagtctacaacccgtcatgcagcccgtactgacttacgcacttgatcctcagcgtgaggagttacacacctgcttagcagccttgcgtcaacttgaagatgaggatccacaattacacgtgacttggtcagaaccacttcaggaattgcgagtacaggtcatgggaacgattcaactggaagttttgcaacaaatcttgcaggatcgttttcaactgactgtaaagtttggaacggggagtatcttgtatcaagagacgattacccaagctgttgaaggtgttgggcattttgaaccgttacgacactacgcggaagtacatttgttgctgacgcccgcaccgcggggaagtgggcttcaatttacgaccgattgttcattggaagtgcttggccgaaattggcaacaccaagtcgtgtcaaacctacaagccaaaacacaagtgggtgtcctgattggcgcaccactaacggatgttaaggtaacactggttagtggtcgggctagcaatgttcattcggttggtggtgactttcgtgaagcgacgtggcgcgcgttgcgtcaaggcttgatgatgttaaaacaacgtggtgattgtcagttgttggagccgtggtatcggttccgtctagaaattggtcaggaacaagttggccgggcgatgactgatattcagcggatgaatggtcagtttgacgcaccggtcgctaatacaagcgtagccacggacgggactgacttgacgacaattacgggaacggcgccagtagcagcgatgcaggactattcacagacggttcgagcttacacgcatgggcaggggcaattggaatgtatcgtggatggctatcggccgtgtcataacgagatggctgttgtcgataagaccgaatatgtccccacagcagatttagaaaatacaccggactcggtcttttgcgcacatggtgcgggttatccggtagcttggaatcaagtgccagagatggcgcacgtcccgtacgtttattcggatgcggaattagcacattttaaggcgccatcaaaatagaaattgaggaaagtcagatgatggatgtgacgtttaattcgacgttcgcggtaaccttgcaacatgagttgcaccagccagtattgagtttgccattgtcgttacaaatcggtgatttaactcgattgacaactgatgatccagcacagcttgctatcatgtcacacagtaccgatgccacggttgtcaagcaagcgttggtaatattaaagtctcaagttgagcaggggggcgtgctacgagtatggtggtctaccatgcccgatgattcgactggttgtgtcagcagttagcagacacagacgcgcaattgagacaagtgatggtaccgctaagtcaagtgataactcggccaggtctagctttacagactttgtcggatttatcggaagtattgccagcggatattgagcattacttacagttggcacaagacgtttctgaggacgaacagcgtgctcatagttatgaatggcaagcgctcgtggtagaaaatgcgccgttacgggtcaatcttaacgggcacttagtcagtgccccagaggacttttatgacagcttgttagaacgccaaatacaaccgggacgcccaattgtgcaaattattggtgagatgctgatgcgctactcactgggcttgccagactggtggtatcgtgcccggctccaacatatcttgtcaacgagaggatgattaatgtgaagaaaattgcgcccctgttcgttggcttaggggccattagttttggaattccggcgtcactatttaaaattgcgcgtcggcagggggttgtcaatggcccattgctattctggtcctttctgagtgcggttgtgattttaggtgtgattcaaattttacgccgtgcacgtttgcgtaatcagcaaacgaattggaagcaaatcggactggtaatttcggctggaacggcttcgggatttactaacaccttttacatacaggcgttaaagcttatcccagttgctgtggccgcggtaatgttgatgcaggcggtctggttatcaacattactaggagcagtgattcatcatcggcgtccctcccgactgcaagtggttagcattattttggtattgataggcacgattttagctgctggtctgtttccaattacgcaggcgctctcgccgtggggcttgatattaagttttttagcggcatgctcgtatgcttgcacgatgcagtttacggctagcttaggcaataacttagacccgttatcgaaaacatggttactgtgtttgggcgctttcatactcattgctatcgtgtggtcaccgcaattagttacggcacccaccacgccagcaacagtcggctggggagtactgattgcactattctcaatggttttcccactggttatgtattcattgtttatgccgtacttagagcttggcattggcccaatcctttcttctttagaattaccagcctcgattgttgttgcatttgtactgcttgatgaaactattgattgggtgcaaatggttggcgtggtcattattattacggccgtaattctgccaaacgtgttaaatatgcgacgagttcggccatagttcaggtcaataccaaactcaaaatgaacatgttgtactggattcatttttgtactgtgttttttgtttcacgtgaaacattcatctaattgatgctctttatgaatagttggtgggtaccttatttatataaatgataaaatgtgcctcacttagggacaacttgaattgaaaggtggtcaggctgatggcactaacctatcggatcgtccgcgctgaagcagacagtgattttggaaaaattcgacagttatattatgagacctggcaatcagcatatcgtgatttgatgcctgcaagttatttacagcaattgacgccagcaacttggcggccggaacggcggtggcaaaatatgttgctggcaatgacggctgatggtgaagttgtgggtgtttgcacatttggtccggccagacatgcgaactatgaggggtggggcgaactgtattcgctatatgttcacccgaactatcatcatcatggcattggtcagcaattaataatccaggcccaccgtcgcttaaaggcggtctatccacagaattatctacttgttctggcaaataatgctgtggcccagcgtttttatcaacgtaatggatttcacgacactggtcagatttatgtcgatcatgcgccgtttggtgttttgcatgagcggatttttgaagattaacgcaaaaaaacgagccttgtgctcgtttttttatagtttagcaatcaattggcgtgcgaccgcgcgtgctgagaacggattttgaccagtgatcaattggccgtcagtaattgcatattcgcgataaaatcgatgctgactaaagatagcaccgtgagcagtagctcgttcacggttaaggaacgggacgatccgttttttgccggcaatcagctcttcagttgcggtaaagcccgtaatggttttgccagcaatcaagtattggcccgtttggtctttgatgtttaggaggccagcaattccgtgacaaacggaggtcacatatccaccatgttgataaatggccagtgcgatggcttgtaactcagggttgtccggaaagtcccacatcacaccgtggcccccggtatagtaaatagcagtgtaatcatcgggatcgacctgactaggcttgagcgtgttcttaagggcccgattaatgaagtcagaatcttcatacacggccattgtggcggcatcggtatatttcatactacgcgggtcaaggggcacgaagccaccattaggactaacatagtcaacggcaatttgggcttgctgcatttcatcgacgaactcagcggcttcacctaaccaaagaccagtcggctcattagttccttggtaacgagtgatattggtttcgacaattaaaacttttttcattgatcatgactccttaaaaagattgatttgaagttagctaattaggttgaatactgataatgattttaccggtagcatgaccggaatgcgagtattctaacgcgtcgttgatgtcggtgagggggataatccgatcaataactggcttaataacgtcctgttcaattagttgtcgcaggcgtacaagttgctggccactaggttgcatgaacagaaacgaataggtagcttgggcttgttgttccagttgactcagtttccgcgttgctagacccaataaccattgtttccatattggcagtccgtaatccttaccaaaacgcgcgtttggcagtccggcaatgctgacaatctgaccgcctggtttgataatctgaaaagcggcctcgagggattgcccgccacgagtatctaatacggcatcgtaatgggataatacatcagtaaagtcttgctgatgatagtcaatgattttatcagcacctagtgattgaacgaggtcaaaatgtttcgcactggtagtggttgcgacgtaagcgccgagatatttggccagttgaatggcaataatcccaataccacccgaaccgccgggaatgaaaaccttctgtcccggctggatgttcattatatcgtgtagtgcttggtaactggttaaacctactaatggaattgcagcggcttcttcaaaattgagattggctggtttcagtgcgatggcttgatgatcaatggcgataaattcagcaaaggttccaattcgatctttgggtgcgcgaccgtaaacagcatcaccaactttaaagcccggtacttggtcgccaacggcagtaattacaccggcaaagtcactgcccataattagtggcatggtgtattgtagtaacaatcttagatcgccatctttggttttcaaatcgattgggttgacactggcggcaacgattttgacgagaacatcggtgggagctattgtcggaacagggacttctgtcaccatgggggttatttgcttgtatttagtaataatggcagctttcatagtggactcctaacatattggtttaaatgtttaacatcttgaacaaaccatgctgttgattctagtcgcttacttacaaaaagtcaacgattaattcttgactttcaattttagcaagcgttaaatggtttaagaatacgaaccgtaattggaaaggtgtgattttttggcagaacgaacgatggcaatatttaagaagggtgttccgatttttacaattcttcaagacgaaaatcggcaacgaattttggtgatgctgtgccggactgatcagatgacggttaaccaaattacagcgcaaatcgccttatcacggccggccgtatcgcaccatttgaagttgatgctggatgccggcattttagcggttagcaaaacaggtactgaacgttattaccgcgctaacatgacggcgactctaaaactattgaaggcactcactgcgtcattagaagccgatttagcccatactcagtctgtagacgaataaaaaaatgaatcagagtgaaaaaagctggtacttttggaatgacgcctctcattccaaaagtaccagcttttagttcacttatgcatttcagcgcactgaatcaccagtacttgaaatggatggcgccatttaatgattatcagtgagctaacgacatgatatcgttattattaatttgaggatggtacttgaatatctttgaaggtgtgccgataaagtaaccagccaagtaagcacgttaagacatcagcgaccgcttgagcccaaataataccagttagtccaaagaactgtgccagaataacgatggcgatacctagtaagattgcttgccgcgaaagcgccatggctagggcactcaaacccgcaccgactgattgaaagacggtcgtgaacacgaggatgaagcccactaatggtgtcgtaatcaacattgctcgcaacatttgtgtacccatagtgacaatgactggttgattcataaatagtttaataagttgaggcgcaaaaatcattagaataatcgcacaaatggttgcgtagccaccttcgacttttaaatcgaagcgcaacgttgcccgtagtctttgccaatttttagcaccgtacgtgtaaccaactaaaggctgggccccaaaagcaaagccgaccatgaccatcataacgaccatgtaaactttttgaacaattcccatggccgccacggcttgggcgccgtatgcggctaagtagctgtttaagatcatcatgccaaaactctgggttaggttagtcagtgaggctggaatcccaaccgcgacgacggctttaagggttggtcgcgagatatgggctaactttggtgctaaggagagcgttttggctcggcgcataaaaaagactaacagactggtgttgaccgcgtaccccaaaacgttggcaaaagcaacgcccgaagcaccccagtgaaagccaaataagaataagggatcgagaataatggtcagaaccgtcccactgatggtcgcaatcatggaaagttgtgccagaccctccgttcggataatgttaccgggaaccagtgaaacgatgataaaggttgatcctaataccaatatacgatagaagtccgcaatgtagggacgggtagctgcagtagcacctagcaagcctaaaattggttgttcgaatagtaataataaggctgtcagtactaagctaagcgcgatcgcaatgtaaaaacaaaagctactgatacgtgcactttggtgataatcatgacggccaaggactcttgaaataacggcactcccaccgaggccaaaaatatcaccaactgctaacataaacgaaaatagcggactgccgagggcaataccagcaactaaatcagcattaccagtttgagcaacaaaaaatgtatctgctaagttataaatcatgctggcaaccatgccaagaaccacaggaaaggctaaatggaaatacgctttgggaatcggggccttctcaaataaatcattcataaaaataagtcactccttctctgaacggtcggtcgaagcgtgactagacgaacagaaagataatataagttaatgatacgcttgactgtcaagctgctcaaggcaccaaactgataaggacggtcagctaaaggaacgacaaaaaaagcattgcccagtgtttcagcggcaatactaaaaattaacgtgaatttttaagagattaacgtaagtcgatttggtgaaggttagctggcatctgaccaacatgatggccgaccgttcctgcgtgcatcgcttgtgcgccattgataaagtgcacaccagtggctgcaattaatcccattcctaatactgtaataatacttaataccatcattattcacccgtttctgattatttctgcacttctattgtagcgcttacatcaccattgtcatttgagttgtattagaatggaattaagtttttcactttttcaggtggacattagtattgggatggaataagtacgcattgtgcgagttaatttgtcatcgattatgattaaaacgtgccattttttaaattcaaaagcagccagcttaggttcgctgggaacagttcgagttagcgtaaacttgcttagggtgcgcgtcctacaccgacctccaggcatttctgcnnnnnnnnnntccagtcgggatagcgttcgaatggctgacaaggatatacccaacttttgctgaatttgtcgttgtttttcataaacgttaattttatcaatcaactgtcagattgaaaaggtcttgtgataactcactatttctgaattaccgtagtaataattgaatatttcgaaaaagtggagaaggcactctgatatttaacttaaagggttcagtatcaaaatagccaacgacaaattgtactgagttcagtggccgttcatcagccattcgagcggcttaccgactggaggggctgggtgacaatgctcagtagccaaattattcttagtcggaagtgggttgcttccggcttagaataagactcgtatttgagaccgggcgggttgtgcacgggctcaaatcgacgtcggcttacgttccagcaattgtcacccagccccggaggccggaatcggacacgcattgctgacgaacaggaatccatctgtttggcacgttttaatcaaggctaatgctaaatagcggctagcataacgcataacgcgtaacaagtaaaaaattagtaacgaaagtgagtgatattttggacgtgcaagaaggatacatgccatttaatggttatcagacgtattatcgaatcgtaggggatcggcaatcaaataagacaccgttagttttgctacatggtggtccaggatcaacgcataattactttgaaggatttgatgacctggccgttcaaacgggacgaccaatcgtcatgtatgatcaattaggctgtgggcgttcatcgatacctgatgacgatcaattatggcaagccgcaacgtgggtggcagagttacaggcgttacgtacgtatttagacttacccgagattcacttactagggcagtcctggggtggtatgctagctattatttatggttgtgactatcgaccacaggggattaaaagtttgattttagccagtaccttgtcttcagcccgactgtgggctcaggaacagcatcggatgattcggttaatgtccccagcggatcagtcggctattgcgacagcagaacggttacaggatttcacaggtgctgcctacctgactgctaatcaacattttatgacgcaacatgcgtcgggcccgattactgctgatgatcctgaatttctacggcgatcaaaacgggtggggaccacggcttataatgtagcgtggggtcccaatgaatataatccgactggtacgttagcggattatgagtataccgaccgattacagtatttgcagatgccaactttagtcaccagtggaacggatgatttgtgtacgccattagtcgctaagaccatggtcgaccagttacctcatgcgacttggacgttatttccccgtagccgtcacatggcgtttatcgatgaaaccacggcctatatgacgcgattgcgtcactggctagcagcccatgattagagaaatgagcgtaatcatttcccgggaaatgatttgctgaatagctagattgagaagtttatcggtgtgatctgattttgtttggctgtcactataatggttattaaaaggtttaaagtagacaaaagcgcctgtggaagttagccttctgcgggcgctttggtgattgctgtgatgatgtttaatgttgatagataaagacgaatcgattagccgtcgagcgcttctcgtcaaattgataatcgggatggtcaaatgtgcgaatggccgtcacatcatcgatttgatgttcagccaaaaaacggaccatggccccacgtgccatcttagctaatgtggctttagtcttgagtttgccgtcgataaagcttgcaaagacaatatcaatcattgattgatgcggagccagataaggtgcaatggtcttagcatattcttgagaagcaagattgataattggttctggccgcggagtcagtgcctgatagaggcggtcgccccaaaacgcatagaggttcttggcttgaccaacagccaaccgtgcttgcatttctaaccgataaggaacgataccatcaaacggtcggagaatgccgtaaaagcctgacaagattcgtaagtttgcctgaatatagtcaagggctggctgggtaaagacgtccggggccatgtaacggtactgaataccgctgtaactgagaatagcgggagtcagattgcgggtcaggtcaattttttgaagccaatcataattaggttgggctagtttgtcactgcaatgccataaggtcttggcctcaggataggtgaggtgttgcagttgagccagtaattgttgcgtctgatcaagatagattggttcagttagggctggaaaggcatcttggtcgataatcatttttttcgcaggtgcaatgatgattttcataaggtcactactttcgaagcgttcagtttataaataatgttgatagcatttaaagcaaaaactaagctatagaaatatgatagcacattagacaaacgtacgttcctaaaactatcaattgcggtataatgaaattatgatactaattgagtaaaaggagtttgtcggtatggatatttcactattaaaacaagtggttcaatcaactaataagattgccctcagcacggccgtcaataatgaagcagatgttaaaattgttaactttgtctggtacgaagcacaaccagatacgctatacttctcatcagttaagacaagtcccgctttgaaggtttatgaccagaatccggatattgcattcattacgattcctaatgatggaacagcgggcaatccatatctacgagcccaacacgttaagttacaacggtcaactaagacgatgaccgacttgctaccccaatatttagaaacagttccgaattatcaacaagtctgggatgctattggatcgacactcgttgtttttgaattaaaactaactgatctttttgttgacgcgggtgttggtggcgagaagcaaacactgacttttaattaacactggattcctatactaaaagcgtttcaaggccggcttaggttaagctatggtcttgaaacgctttttggtcgggtaattttaggagcaactatgaggtgttacttcacatatgcggtccgataattggcggcaccgctgaaattattatagatgacgccctttaagtgcgacttaacgagcagatgggaacggccttcgtagagtggggtcacggcctgatcagttagcgccgttttagcggcttgaactaagtcttgatagcgcttggtcgcgttcaaagcatctggaccatcagcggcttgcattgcctggtcgtaagccttgctttgatagtggcccatgttggagttactgtcgccagtcaaaattgttaatgattgtgaagggtcggcaaaatccatactccagctagttaaattaagctggaaggttcccttggaaactttacctagcattgcggtaaatggcattgccttgattgttacctttagtccggggaggtgactggtcaattgtccctggatgaattcagcgacctgatgtgagttgtcatcatcaccacaagtaatcgttaacgttagcgattttttgcccaattgttgttgtgctttatgataagcggctcgagcctggttgagatgataattaacagtaccatcaacggtcgcatcattgacaaaatcggtaccagttttaggattcttagccatattgcgtacaccaaagcttttggctggaagcgaaccattttctagaactttgttggtcagttgcgaccggttgattgctaaggataaagcggtgcggagttcacggttggctgctacatggtcatggtgattgtattgaataaagctgatttgaccacccgcaagtgttttgagttcttgattatttttattctggacactctgctcgccattaagtgtcacactatctaacttattagattgatataaattataggcagtcgtattggacttaataacctgataattgatttggtgcagtttcaccagtttgtgatcgtaataagctggatttttctttaaggtccacgtattattagtcccggtccagccagtaagcgtaaatggcccgttgtagacggtcgtcgcggctgaagtcccgtacttcttcccgtatttgttaacagcattttgattgaccggataaaaggtcgaaacagctaaaatctttttaaagtaggcgacgggtttgcttaacgtgattgttaattgatagtcaccattagctttgacaccaagggttgatggctttttcttgccggctgcaatggcgtcggcatttttaatgtttgtgaagacataggtgaattcagatttattttttggatcaagagttcgtctccatgaatagacaaaatcgtgagcggtcaccttgttaccgttactccagcgcgcatcgtggcgtaattgaatggtataggtatgaccaccattggtgacagttgtcttagtagccaaagcgttgacgggttggctctgactgttcagccgatagagcccctcgtcaacttgggtgacttggctattagaaacgctgtccgtcattttagcgggatctaagctcataatttctgagccagctgatagattgataacttgtgattgtttagtcgtagctgggtgcgagtgggcgttgacggtaaacccgatgccgccaataatagccacgctgccgattgttaaaattaatttgtgtgttccggataaactcataattaaatcctccaaaaatataattgtattggtagattgtaaaattaannnnnnnnnnaaatttgcaatctaccatttggttagtttgatccatgagttttgccatcgtttcgtgaccatttatttcaccccgcttttatcgtcaaaaaaaccgtccttatccagccaatgctgtgttaaggacggtttgataaccgcggtgccaccttaattgagtgttcgccaatttagtgattaaatcacgcgtacactcctactccataggaaactaacatttccctgacaactgacgtatgtcgcacgtctttccgtactctcaactgacgttaatttcggcaaagccctcggtggtccatttaattacctgcgttcggccatactctcagcaacgatgactctctgtgcgggcacgataatcttgatctccacctcattggtttataaggacgatattttgttgaagtgagtataccgcttttgaaaatcagttgtcaagagctggaaaaatattgttcaactataaatttagtcaaacagaaaacgatgttcgtaaataaaccgaggattaatatagtgtcgcgtggcattgattgcgtggcttttaataacggctgcaagcattaattactttcattatgcgcgaataaaaattataatgacatcaataatgtaaacggattcaatattgcggtgacaagattaaggagggctaaacatgagctttagagttgtagccggttatttcggtgaatttagtgatgaagcgaagcgggccaatcaagacttaggtgtaatcggcatgtcgtttcagtatcaatgtaatctcgtttatccagaaggggcggggccaaactttggttttcgaaccgacgcgcaagcgattgatgtgttcgatgcgttaaaagttggttacgatggtttcaaagtgcaagctggcctgattaaggcgatgggactagttgattatcaattggttggtggtcgttacgaactagtcggccatgatttccgagaattacctttagctgagatcaatgcgaacttggaaacgatgcccggactcttggctcagggaccgatgccagttcgatatgtgacttatcgtcggacggatgaccctattgacgcggttggctttagtggcaactggacactaggagatagcggtggctttcgacagttaagtgagacgttggcagaaccaatgcaagcaccagtggcggcgctaattaaggcaattgatcaacttggtttaacgttacaacaaattaatctacccacaccgcaaagttcaacggctttgccgacacatttgagtgatgatgttcatcaagcgaacgttgacgtgtgggtggtgttaacacagccacaaggtgacgagcagcaagttttgcagaccattcataacgctcaagagtgtaatgaaaaattgtgcgaagcgctgactcgtgtttatttgaagtaggatgtttcacgtgaaacaactggcacttggcagtccgttattttctttagtgcgttgtatgatatgatacgcacgaaccgtaacacatcttcacgggagaaaatatgttattagaaacttatcagcatcccgaattgtcaaatcaagtnnnnnnnnnncttcaattttaaatccggcaacttatcagcatcgctcatttatcaaacaaactggcaatatttctatcgaacgtgattgggaaaagcttttcgacgaagcgtggttgattaagcatcttcgtggctatcgctaagctcaagacttagaggggagtggtttgatgatgacatcaacaccacggttattacaagccattcaacaaacgaccaccgcaattttaaaaacaaaccttgttggtatttacctgcatggatcctatgttttaggctcatataacgaacaggtgagcgatttagactatctgatcgttgttcggcgttcgttaacattagctgaaaaacggcagttaatgacagctaccataacgcaattgtggccattagcgccacacaagggattagagtttcatgtgctgttactgagtgcaacccagcattttgtgcatccttgcccattcgattttcatttttcaaaataccattatgaggattatcaacggacaccgctagcctacctaaaagcgatgcacggcacggatcctgatcttgctgcccacttaacgattctccaagcagcgggacaagtcttacttgggccagctattacaacggtctttggccccgttcctgcgacggcctattgggacagtatcaagtctgatatcgcgaatgctgaaacggcgatcgttcagttaccaatgtatacggtattaaacctttgtcgagttcgcgcttaccagcaagatcagttaattatttctaagcaggccgggggtgaatgtgggttacaacagctgccaacacagtggcatccgttgatcaggcaggcgttagcagcctatgctggtcaacaggacgaacaggttatacgatggtcacgtccaaacttagtggcgtttgcacgaatcatgttagctgagttgggcttaaaatcagaatagtttgtgagtttaacaaaaaatgcttactggcgatcatccaccaataagcatttttgtcaccaccaacttaaagtcggctgttataaatcaagaaactaatgtagcagttatcgccatcaggtaaatcatagccagtgttttcgttgctaccgtcattttcgtgtaaaacaacgaattcaccagaaccataatcttggtcgtttaaatacttcactaaacgttcatcacattcagctaaagtcttaccggtcacaacgcgccggttccaaccacgatggatctcagtatttggattaagcatctcttctcaactcctcttaattataaagtcatcaattgcgcttgccgagcgggttgctgatcaagatcagcgcgcgttaggtcagcgtcgacttggtgggtactgttaaaaataatgaaacgttcaccaacggcttggacttgctggtagttatggcttgccatgatgatagttttgccggcagcttgtagccgttgcagtagggttagcatttgctgctgagcggcaattgttaagccgttcagcggttcatctaacaataaaatttcagggttcaaggcgagaacgctggctagtgctacgcgcttcttttcaccacctgaaagttggtaagggacccggtctgctaagttagcacagtccgttaattgtaagcagtcggcgacgcgttgcgcaaccatggctgctgataaaccgagttgtcggggaccgaaagcgacttcctcagtgaccgacgtgttgaatagttgaacatcagtattttgaaagaccatgccgatccgctgatgaagttgttgtcgattttgggcatcagcgagataagtggtcgtaatcggctgatcgtgaaactgataagtgccactagttggactagctaatccactcaatagtcgtaaaagggtcgatttaccagatccattgggccccattagacagacaaagtcgcctgagttgaccgttaagctgaggtccttcaagccacacgtatcaggataatcatagcaaatattcaccaatttaatcaataccacgttaatgcctccaaaaaataaataatatccagacaataatcgctgggctcagggcaagataatcgcgccaatgggtacgacgcccggttgagcgcgcgtaatgaccattgaacccgcgtgcttccatggcagcgtatagttctagcgcataagtgtaacttttaagatataaattaccaaataatgcgccgattaaacggtatggatgagccgttggggcgaccgtccgcaattctagtgcttccatcgtcagcaatagatgttggccgagcattcgtaagtacgtgatggcaatggccaaagtcataattaatagatcagggcaatggagtgccttcaagccagccaataaatcttgaaacggcgtggttagacggtaatattgagcgtttgccagcattagactggttttaaggccaaagaataataacgtggtgggaccggctaaccagtagctcggtaatacgaacagcatggccatcccaacactgattagccagcttcccataaaacggcgcagttggcgtggaggtaaccataataattggcacccaactaatagtgctaggccccataacagaatgagattattacttaaagcaattaaaatgacgagcaacaggagctgaattaatttgaattgcggtgcaacgcgccaatgagacgttgccgtgactggcgctggctgtgctagtcgactgagtaattggcgtaggtgacgctgattacgttgccaaaatttcgctttaatagcaggtgttggcgtggtggtcgtagtttgcagccaagctggaatatcagtgttgggacgtgtcggtttcatgttgaagacctcgaatcaaaagtaagaaaatcaaaacagcggtaatggccgataaaatataacccacactgaccggtaagcccgcgatggcgtaatcactgaacagggcctgaaaatggaacccgtggaccattccttgaggcgcgtgagtactgatatgttgttgcgctagccgttgctgtaattcttgggggctccattcgccccaagccgtattgctagccaacaagcctaatggtgataacaccgctaatccgagtagcagtgcgatccacggccgctgattgcgccgagtgggtgtctgatagaggttagtcggtgcgactcgttttacaaattgaaagacaagcagtgtgaagacgacttcgacccagccggcgactaataagtgagccgtcaacattgcgggtatcgtaatgttgaggccgtatgggcagtagagcggcgcaccacttgccgtatgagccagtatgggttgtaacccgagctcgataccagcaactagcgccgccatattaatgcctaagtaagcaccaattgcgagccccaacttttcatggtgccatttttgacctaggcgatagcaggcgtagccgacaaacggcataatgaccgccatattcaacgcgttagcgccaaaggctaggataccgccatcaccgaataataaggcttgtagtagtaacgtcacggtcagcgcaagacacgccgcccatgggccaatcaagacagctaacagggttcccccgacagcgtgagccgtggtcccacctggaatcggcaagttgaacatcataattaaaaaagccaatgaagcggcgatgccgagcattggcagggtttcatgatgttttttgatttgaactttaacttttaaaacggcgacggtccagacgggagccatcgcggtgaccaacgttccgcaagttgcgggacttaaataattatccggaatatgcacggatgagcacctcactaatttgcaatttgatctaagaggtaactaacatcttgaataataaatttgtgatttttgaccgtaatgacgccgtctgttcgtaattccttgagcatccggttgacactgctccgggagctaataccacagaaaccggcaatgtcgtcattggtgaccacaaagtcaatcagaatcccttcgtcaacttttcgtccgaacaaatcaacaagactatagataaaggcacaaatggctccttttttaccgttcatgaccatccgttgcagtcgaagaatgttttcggacaactttttacggtaataatttttaacgtagttttgcagttcaggcgtgctgttgacgtacttccaaaaagcgacccggttgacctggtaaaaagtggcatattcggactcaatacggacgttaaacggttgatccgtagaacgagaaacttcatcacgcagcagggagatcacgtcgggcttggcaatataagataaattatattcgcgaccgtcttgtaaaataatgctgtttttgatgatgccgtcctttaagacgtacgtatagtgttcggctaaaccatgataggtcaggtaagtatgccgcttttttttgattgtcggcacgtgatgggcttccaaataacttagtaaatattcaatatcagttaataccatcttagtttttcagttctttcgtgaatgatttttaaggttgaggtcagtaaaaatagcgattctcaacggtaatcacgacgataacgctacttaagcatagcggttttcatgattgtgacaatcgcatttaaagtatacatttgttaactatttttgaaaacttaaaatgtaacggacaagttatccgtcttctagtataacaaaaaggtgcatgtaaaaaattagtttttagagaaagaggatggctaaaagtcatggttgcaattgatttaccatatgacaagcgcacaattacggctcagattgatgatgaaaattacgccggtaagttagtgtcgcaagctgcaacatatcataacaaattatcagaacaggaaacggtcgagaagtcgctggataatccaatcggctccgataagctggaggaacttgctcgtgggaagcacaatattgtgattattagttccgatcacacgcgcccagttccttcacatattatcaccccgatcctattgcggcggttacggtcagtggcgcccgatgcacggattcggatcctcgtagctactggtttccatcggccatcaacccacgaagaattggtgaataagtatggtgaagacatcgtcaataacgaagaaatcgtgatgcatgtctcaaccgatgacagtagtatggtcaagattggccaattaccatctggcggcgattgcattattaataaggtcgctgctgaagcagatttgctaatctccgaaggctttatcgaatcacatttctttgctggtttttcaggtggtcggaagtccgttttacctgggattgcttcatacaagacgattatggcgaaccattccggcgaatttattaactcaccgaaggcccggaccggtaatttaatgcataatccgattcataaggatatggtgtacgctgctcggaccgctaaacttgcctttattatcaatgttgttttagacgaagataaaaaaatcattgggtcatttgccggtgacatggaagccgcccataaagtgggctgtgactttgtcaaagaactttctagtgtaccagccattgattgtgacattgcgatttcgacgaatggtggttatccgcttgatcaaaatatttatcaggccgttaaaggaatgaccgctgctgaagcaacaaacaaagaaggcggcacgattattatggttgccggtgctcgtgatggtcacggtggtgaagggttttatcacaacttagctgacgttgatgatcctaaggaattcctggaccaagcaatcaacacgccacggcttaaaactattcctgaccaatggacggcccaaatctttgctcgaatcttagttcatcatcacgtgatttttgtgtcagacctcgttgatcctgatttgattacgaatatgcatatggaactagccaagacgttagatgaagccatggaaaaggcctacgcacgcgagggtcaagccgctaaagtgacggttattcctgatggtttaggcgttattgtgaagtagtatggcaaccacagcagaaatattgcaacaagtggcggcagggcaattaagtccgacggtggctgcccaacagttagaagcaggcaaaacagcggcattaggttttgccaatgtcgatttagatcgtcaacgccgcaatggctttcctgaggtcatctacggtgctggtaagacggcaacccaaattgtgggtatcgtgcaagccttgtcccaacagacgttgccgattttaacgacccggttatccgcagaaaaattcgcggcactccaaccggcgttaccaacggctgtctatcatgccactgcgcagtgtatgacggtcggagaacaaccggcaccgaaaacaccagggtacattgccgtggtgacggcggggacctccgatcaaccggtcgctgaagaagcagcagtaaccgcggaaacttttggcaatcatgttgaacgggtctatgacgtgggtgttgcaggaatccaccgactgtttgccaagttggatgtgattcgtggtgcccgggtggtcattgtgatcgcgggcatggaaggtgcgctggccagtgtcgttggtggactagttgataagcccgtgattgcagtgccgaccagcgttggttatggtactagttttcaaggtatgaccgcgctattgaccatgctcaatagctgtgcgtcggggattaccgttgtcaacattgataacggctttggtgccgcctactcagctagtatgatcaatcaaatgtaagattcagttaactgaacaaggagaagataaatgcaaacactttatttagacgctttttcggggattagcggtgatatgtttctgggcgcgttactcgatttaggacttgattttgagcaattaaaaaccgaattggctaagttacacgtgcacggttatgaattaacgcagcaacgggaagcccagagtagcatctatggcacgagctttgatgttcaggttgcgggtggtaaggaccatggttttgtggaacatcaccatcatcagcatgaagctgggcatcatcatgatcatgaagcgcgtcatttagctgatattgaggcgttaattgacggcagtgacttatcagataccgtgaaacaccacgcgaaagcgatctttatggaaattgcgcaagcggaagcagcggttcatcacatgccactagctgaaattcatttccatgaagtgggcgcgttggattcgattgttgatattgtgggctgctgtattgggttggaattgatgcagattgataccatcatggcttcaccgttaagtgatggtagtggttttattaacgttgcccatggtcagatgccagttcccgtcccagccgtgatgcagatgcgagttggtagtgccattccgattcaacaacggttggatgtgcatactgaattgattacccccactgggatgggcttggtcaagacgctcgtacgtgaattcggaccgttaccggaaaatgccgtgccaactaaagttggttatgggtttggtaaacgggacacgggcggtttcaatgcactgcgagccgtattattcgaaaaaaaaaactaagtcagcaaatcgttaaccggacggctgatgctgtcttaatgattgaagctaatctagatgatcagacgggtgaaggactggggtacgtgatgaaacagttattaacggcgggcgcatacgatgtgttcttcacgcccattcagatgaagaaagatcggccggcgacaaagttaacggttttgggaaacgttaacgataaggacttactgactaagttgattttacaagaaacgacgacgattggtgtacgttaccagacgtggcaacgtactattatgcaacggcacttcctgacggtcgcaacgccgtacggtgacgttcaagttaaagtggcgacatatcaagatattgagaagaagatgccggaatatgcggattgtgcccagctggcgcagcaatttcatattccgtttagaacggtctaccaggcagccttagtggcggtagatcaattagatgaggaggcgtaattttttggtacatcagttgattgctgaatttatgggcacagccctaatgattatttttggggtgggtgttcattgtagttccgtattaaagggaaccaagtatcggggttccggtcatatttttgccattacaacttggggttttgggattagcgttgccttattcatttttggcaatgtttgcattaacccggcaatggttttggcgcagtgtctattaggaaacatcgcatggtccttatttattccgtattccgttgcggaagtgcttggtggggtcgtgggctcagtgatcgtttggatcatgtatgctgatcattttaaagcctcaacagatgagatttcacccattacaattcggaacttattctgtacggcaccggccgttcgtaacttgccgcggaatttctttgtggaattatttgatacatttatttttatttcgagtattttagcgatttctgagattaaaacgccgggaatcgtgccaattggcgttggcctacttgtatgggccattgggatgggacttggtggtccaaccggattcgcaatgaacttagcccgagatatggggccccggattgcccacgccatcttaccaattgccaataaagccgatagtgattggcaatacggtatcattgtgccaggaattgcgccctttgtcggggcagcaattgccgcttggtttatgcatggattttttggaattaattaaattaaatagaagaagggttttattatggcaacattagcaacaaaaaaagcaacgttagtagcagcattaaaggatttacaacgggtcaccgtggccttttctggtggaatcgacagtaccttagttttgaagatggccctcgatgttttaggccgtgacaatgtgaccgctgtggttgcgaactctgaattatttatggatgaagaattcgataaagcgatgagtttagccgaagaactaggtgctaacgttcaaggaactacgctagactacttgagcgatgaccacatcaagaacaacacgcctgatagctggtactatgcgaagaagatgttctacagccggttgaatgacattgcggctaataacggtagtgccgctgtcttagacggtatgatcaagaatgatgaaaatgattatcgtcctggtttgaaggcccgtagtgaagcgggggcccggagcttgttacaagaagctgatttcttcaagactgacgttcgggccttggcacaagaactcggtttgacgaactggaataaagtggcgtcatgctctgtatcttcacggttcccatacgggacgacgttgacacatgacaatattgctcaagtaatggccgccgaaaaatatttgcgtagtttaggttttccaacggtccgggttcgtttccacaatgatattgcgcggatcgaattaccagaagcacgaattggtgatttcttagtctttaacgaccgcgttaaccgtcaattacaatcacttggattccgctacgttacccttgatttaggtggcttccgtagtggtcggatgaatgatacgttgaccaaggcacaattggccactttcgcctaggcctaatcaaattaatgatagtggtgtcgggattaatcggagatgggcggctgaacggcggtgatcatggttcattcgcccacccgatgataatcgtaaccccagccgatacgcacatgttgcgattatcgcctgacaccccaaaaagcgcagttcaaggccgcccttgagctgcgtttttcgtatcttcatttttagatcaacaggcgtcaaaagtcacgacgagtttaccaacgacttgaccagcttggagttgttgtaaaccagttacaagttggtcacggtgcaagacctgagtaattagtgggtcgaccttaccagtttggaccaaagctaataaggcggcggtcatttgcccaagatcggcaacttgcgctgggttaccgctacggtgggcaccaccgaggtccaatttactgatagttacaacttgattacttggaaagtggtccggagttgctaatacacagacaagctggccattgtaagctaagcgcggtaagtccgcatcagcatgaccaatggtattaatgatcagatcaacaccgtgctgctgcgttaggtcttgaatgcgtgtggtcacatcttcatgatggtaatcgatttgggcatcgggatgcagcggtgccacgaaggcttgcttggcctgtgaaacggtcgtgaagacggtcttgccagcagccttagcgagttgaatagccatactgcctacaccgcccgcacctgcatggatcagcacagtttgcgcggcatttaaattggctttgcgcaggagggcttgataagccgtcaatccagcgcagagactagcggcggctgcttcaaagctcacagtcgttggaatcttagctagcacggctgccggtaaactcacgtattcggcaaatgtcccattattggcgagattagcgtgcccacaaactcgttcgccaggccgaaaattagtgacctcagcgccaaccgcctccacgattccagctgtgtctagtcctagtgtgtgtggatattgccaggcggcgttacccgccgcaactaatttaaaatctaccggattgagcccgactgcttgggtcttgatcaacacctcagttggcccgaggttgggcatgggccgttcttgccattgaagctgttccatagtttgagcggatggatctggcacaacaagtgcttgcatcttcaatcactcttttcttaaaggcatatttgctttttattataaccggtcgcggcggtgaatttaaactttaatgcctaattaattaagtagcaatgagggtgattcggctaacggaaagattgacgttagcggttacaatcgttagactaaggttagcaattgaatatttttaaacactaggggtgtccaaaaatgggctgagatggtgctgtaagtgccgatccctctgaacctgtaagctcaaacttgcgtaggaaagtgtcacagctaatgttagcggccactggatcaatgcatgttgattggtggtcgtttttgattggtgtgacggtcaatgaggaggagaattgctatggaattacaattattgaatactttacgggatcacaatccgattgtttttaacattgccaattttgttacggttcaagacgttgccaatgggctaaacgcgttaggggcctcgccaattatgtcagctgaagtccaagaagcggagacgatggtccaaattgccggggcagtttgcattaatttaggaaccttgaccaccacccagattgatcaaatgcgagtggttggtaagcttgctaatcagtatcataagccagtcgttcttgatccggtggccgtcggggcggtcccttatcgaaaagaagtcgcgctagcattactatctgattttcaagtcgatgttattcggggcaatgctggtgaaattgcggcattggctggcatggattggcaagcgaagggcattgatgcggggagcggtcagggcgacctggttgaaattgctcaagcttgtgcacagcaatttcaatgctgtgtcatattgtcgggacctactgatgttattacggatggtcggcgcgtggttaaagtcgctaatggtaccccgcttttccaacgtcacgtgggctcgggcgatttactttctagtatcgtcgcggcttttacagccgttagtccaaccgatatttaccaggcggcgcaagtggcttgcttagtcttagcgggagcgggggaacttgtcgccagtcagctgacggccgatcgtcccgccacatttgccattgatttgattgaccggctgagcttagtgacagtgtcagaaattcaaacaattgctaaagttgattaaatataatgaagggtcgcgagatttaatgaatgaatttccacaagtggcaacgattgctggtacggatagtggtggcggtgccggtgtcatggccgatttaaaaacgatgcaggcacgtcacgtttttggtaccgcggtagtcgttgccgtgacagctcaaaatacattgggggtccaagattttatggcaatgccgacgaagctcattgacgaacaatttgcttcgttagcagctgacttagacattcgcgcttgtaaaacggggatgcttgcggatgctgaacatgtccatgccgttgtcgagaacttgaaacgagttgattttgggccgctgacagttgatctagtcatgattgcgaaaggcggggcggcgttattagccgcggatgcgattaaaacggttcgcgacgaactgctcccgttagcgactgttgtgacgccgaatttgccggaagcagaacgattaaccggtcaggcaatcactagtaatcaagcgatggttacagctggacatgcgctacaggggttaggtgctgacaatgtcattattaaaggtgggcatggtgataatcctgatttagctaatgacttcgtattgttagctgacgggaccgccttttggctttcggctccacggattgatacggtgcggacccacggcacgggagataccctgtcggcatgtattaccgccgaattagcaaaaggacggtcaatggctgcggccattaaaacggctaaggcgtacgttgctgggacgattcaggatggtatccaggtcgggcatggtcatggcccgttgaatcattgggcaaccccaagtgagcaggtgatcgttcatgacgcttaaatttgaacccacacaattacgtgcttattttgtgtgcgggacacaagacgtgccgggacaggatctaaatatggtcgtccaaacggccttggatgcaggcgtcacggcattccaataccgagataaaggcaatagccagttgactacggctgagcgttttgcattggggcagcagctgcgggaacgctgtgcgcaagcgcacgttccctttatcgtcgatgatgatgtcgagctggcactcacactgcaagcagatgggatccacgttggtcaaaaggacgaccgggtgacacaagttattcaacgggtcgctaatcaaatgtttgtcggtttgtcttgttcaaccttagctgaagtgcagattgctaaccaattggaaggcattgcctatcttggtagtggtcccatctttccaacgacatctaaggccgatgcggatccagtagtcggtctgacggggttgcgacaattagtcatgactgcatcctgtcccgttgtcgccattggcggaattactgtcgcgcaattgccagctattgcggctactggtgcggctggcgctgcggtgatctcaatgttaacgcgtagtcccgatatggccgccacggtcaaggcgatgctaacggctacggaggggcactgatgaaacatgacgggatttttcggagccaatttttactgtggctcggtgcggctatctcaattgccgaaatcttaacaggtacgctgatggcaccactggggctgacacgcggattggctgcgattgtattggggcacttgatcggctgtggcctgttcttggttccagccggctatttgggggctaaattacaccagtccgcgttagcatcagcccaactggattttggtcgcggcggggtgttactagcgtcaggactcaacgctttgcaactcgttggctggacggcggtgatgatcgtcaatgctcagttagccatgaacagtattagtggaaagctatttggctttcgaagtccgctattaatggcaaccatcgtggcgattttgattattgcgtggttgctcatgggtagtcagttactgttcaaaatcaacaatgccgttgtgggcttgttggtgctcgggacggtgttaatgctcgtaatggtatttatggcaccgacaactagtcagtcggtatcaacgactagcatgacgtttgggcaagcagtggaattgaacgttacgatggcactctcatggttgccactaattggtgattatacccagcgtgttgatcgtcctttaccagtcgcactagtcagcgcgggtggctatatgttaggcagcttagtgatgtttgtgacggggctattagttgtgttacggacagggcaaactgatatcacggcattgctgacgcggtccggtttaggattggttgcattgctgattatcgttttttcaacggtgacgacgacatttttagatacttattcggccgccacgagtttggctaatctgaccggtagccgccatgttaatcgattagccgttggtgtgacggtagttgggctattgattgcgctgacggttgccatgacgtattatcagaacttcctgtatttgattggttcggtcttcacaccgctatatgctattattttcgtcacgtactttgtgcggcacgccacgttaccatactggttgaacttttgctggtgggttgtggggattgtcgcctattatcagttacaggccattgatttcattggtggcacgacgctattagtattggttgggctgagcatcgccgtctggttgacgggaattatcgtcaaaccaaccgagctcgaatatcgcgagcttagtcattgacaattagatgtaaaaagtaaatgataatcccattggtaatacgcatgttaccgtgggatttttttgagagagggcgacagaatggttaaaccgataattggaatcgcaccaggcgttgtgacagtgaacagccagatgttcccggggcgggtccgtgattatgtgaatcgtgattatttgaaatcagtaacggataatggcggtgtgccattggtattaccggtaacgaccgacgcaacgacgattgaacgatacgttggaatgatcgatggtctattactttgtggtggtgcagatgtggcctcattgacgtatggggaggaaccccagcctaaattgggtggggtaaatccggaacgggatcagtatgaaattgcgctgattcgtgccacccacgccgttggtaaaccggtgttcggtatctgtcggggcttacaaatcttaaacgtgtgttatggtggcaatctttatcaggatatgagtgaattaccagctggtcagggtaccttaaaacatatgcaaggacaattggccgcttacggcatgcatcacgtgaaggtcgtaccaggtacgaccttagctgaatatttaggcaccactagtgacgcaatcgcagtcaattcatttcatcatcaggccgtgaaacaggtggcaacgggctttcaggtggtggcccaaagtgcggatcaggttgttgaagcaattgaggcgacagctggtggtctacagttgggtgtccagtggcatccagaaatgatgcaacaagtaaactccgtgcaggcgcggttgtttgcggcgtttgtgcgggcttgtgtggcgtagatagcattgactagcaaattgataaaatagggcgtggttattctgaattgtaggataaccacgtttttaatgtgcggccgcaaaactaatgaatgtttcacgtgaaacatctgaaatggtgttggcaactagataactaatccaagatattgtaagctgacgtgtaaaacaattcgtaaagctgttaatactgtcagcgctttcgtataatggaataaagttattgttaagggggtgaccgctatggaacgaattgaagctggcatgagcgtaatgacgttgaagaagcagacctatcgggttatcgctgtgattaatcaggggcaagaactgttagttcgcgcccacgagccagaaacagctgacattgaaataattccagtaactacagttgttcaagtaactgaacaaaattcaacagacgatgcagccgtcgcattggatacagtcacggtcgttggcgaacggtatgtcgatgatattgtggcaacgttaacgacgctcggagtgggtatggcggtgttgctccagcgagaaagtggcaatcaatacgatgataatgccatctcagtgtggacgttgcaacatgctaagttaggctacattgcccggtatcagaaccagccgtacgcggcactgatggatcagggacaacgattgtacggcatcgtgacggtattagatcaacaaaaacagcatcttgaattgatgctatggcggactactgcagtcccaagtccgattgaggcgttgcaaatccgccaacgattggctaagccgaggacaaatttaggggcggtgccaacgcattcgttacagacaccgttaggaacaattgtcatgatgtgcaatggtcacccgattaagtatcagcaggttccgttatcgccatggttgacgcccactgatgaattacacgtcaccaaacgttatctattaacgcctgattggtcacaagtgccgccggacagcctcattacttgtcaagtgacggcgaaggccgacgtggttcagcggtggcaaaatgaacacatttcagcagcggtcttaacgaacgctagtagcttttatgtggttggtatcagtgctcaaaccaagacggggctgaatgataacttggtcgatgatgctgcgcaacccgcggttatttaccgagttggccagattagtgcacatatgcaggccggcttcatggtcagttgggcgccgtttggtgatccgcgcgtacaaccagcactgaaattagcattgcacttctcctcacaaccgctagttccttaccatccagtaacacctagtcgcaccaacgcgacgtttacgcagcaagagttggcagccttgttagtctccgcattaccaaattatcagggtggtcaacgcttagaaccaagtgtgacagcgataacggtagaaaaattgcggcagacgttaggtgatcagacgtatcatgcgctggcgaattatcagcgtcatgttcagctagttgcgggtagtacggaaggcgtcaacgagaccttgttacaggcgttgattcatgcagtcacgtatcatgagttgacgaccatgcactactaccagccgactgtagggatggtcgaccaggttatttatccgattcaattatttagcaccacgactaaggatgaggatgatgcgcaattagtgggttgcttagcgctttacaattacgaaacgtttgaaatccaacaggtgccgctgacggcaattgctcgtatcgcgattattgccgatccggagcatccccagacaacaccggagacggaaagtccggattggttacgcatatttttacatgggtggaatgacgatttttgaacgaacagtcaaaaattaatttgcttacgacttataagtattcgtgatacaagccagattgaattcgataaaaaatcccgctgaggctttaagctcagtgggatttttggttaggttatttggttgccgaatgggtctgtaaatattcctgggcggcgtgaatcatatctgcattttgttgatttaacaatggcggcaagttgtcgaagtcaaagtagtcgagtttgagtgtttcatcagtggcttgggtcagaacgtggccgccaatgggttttacaagaaagagtgcactgattgtttgagctacatcgccgttaggataggccgtctcgcctttatcaaagatgccgatgcgatcaacaacttcgacatcaatgccactatcttccttatattcccgcaagcaggccgtggcatacgtctcaccgtattctagatagccaccgggtaaactccagttatgcgtatcggtacgaaggttcagcaagacttgttgctgatcgttgactaaaataccagcggccgtattcaaaatgattggtttgtgaccaaccaaagcccgaatttctttaatgtaatttgccatgacgaaacctcgtttctagtttaattacccttattataccgataattctgactgaaagctgtttgttgataaatttatacgaagcatgctcgaaccgcgttagagcaagtacatactgactatgtgtcactaaatccgtttgcgtcggtgcacttttttagctaagataaaagctatatactgtcagccgtgatagtgtgagttctttgattttatgaaaagagagtaatttatgcagagaaaattaagtacgggccagatgcaaatgattgcactgggcggcacgatcggagtgggcctatttatgggatccagctcaacgatcaagtggaccgggccgtcagtgctaattgcgtacatcgtatcaggggcctttctatacctgattatgcgggcactaggtgagatgctgtatgtcgatccgaataccggttcgtttgccaagtttgcttctgaatatattcaccccgtttttggatacttgacggcttggagcaacatttttcagttcgtcgttgttgggatgagtgagatgattgcactaggcggctactgccggtattggtggccgaacttgccagattggattccgggcctaattgccattgtattcttatgcgcggccaaccttatctcggttaaaatgtttgggacgctggaaacctggttctcacttattaaagtggtgacgattattctgatgattattgccggtttaggtctgattatttttggtattggtaacggcggtcatccaattggaatcagtaacctgtggacccatggtggtttcttcactggtggggtgaagggctttgtcttcgcactagcaattgtgttggcgtcgtatcaagggattgaattgattggagtcacagctggtgaagctgaaaatccacaaagcacgatcgttaaagcgattcgttcaacggttgcccggattttaatcttttacgtgggggccatcttcgtaattgtcagcatttacccctgggataagttaagccagatcggttcaccgtttgtacagacatttgccaaaattgggattaccgctgcggcttcgattatcaacttcgtggttattacggcttccttatcgggaacaaattctggaatttatagtgcgagtcgaatgacttacacgttggcggaaagtcaccagttaccaaggaagatgactttattaaatcgtcatggagtaccattttattccgttattgcgattgcgaccgggattctaattggagtcgtcttgaatgttgtattaccaatgtttttcaaggacgctagcgagattttcgtgatggtttacagttcgagtgtcttgcccggtatggtaccgtggtttgttattctagtgagtcaaattgcgttccgtaagcaaaacgcagccaagatggcgaaccatccttttaaaatgccattatcaccctattcaaattatttaacgttggccttcctcgcgttaacactggtcttcatgtttattaatccggaaacgcgctactcaattttagtcggtgttgtatttctggtcatcatgacattgatttatttccgtaaatacgccggtaacaaggaagaaacgttgtaatcaagagcacttgccagtaaatggtaagtgcttttattttgggcttttattgcgttaaaattaggtatcaatatcaatatcaatatcaatataattatcaggaaaagtggtggcacgatggtcaagcaaggacattatgcaaaagtcagtaaacagaaacggttacgacaattaaagcaacgacgtcaggcccaggagaagcgggcgattatgccagaaatggttagcgaatttttgcaagtgcgttaccacctgacgcaagcggcaaaacagcggccggcgatgcgacagatgatgcaacgttttatggcacagtggttagccgcagggcaagcagaattgagcgacaatggtcagacaacgtggtcagtagtggcattgacgaagcaaacgttacagacctttaatcggcagttaccgtggcaggggtatgccttagttgaccaggaaatggcgcgctggacggcttttctgaacaaggaagtgccagctgtgccgttaagtgagcggattacgttaactgaggcactgtccccagcgacgtggcaggcctgcctatcagagcaattagcaatcaatgccctattagcattaactggtgattcacgacaattgggccaaataacgactgagcaagtacgacagctacaaaccagtattcaaacagcgacggggattgattgggaaaaggttgctcagttgcttgattcgacagtgattgcccagaatacactttccgaagctgggctggatgacaagacgcgccaatggctagaaaaattaaagaagctaacgccacaagattttaacgaccatgttgaatgaatagtcaaaaaaggaggatggtgaaatgcgttttatcacgtcagatcacgttcagttagattatacggatgaaggccaggggcagccaatcgttattttgacgggatttggtggcgctaaggatatttggcgcgctcaaatcccggtactgattcaggcgggctaccgggtcattaatttagatgggcggtgccaaggtttatccgagcacacgacgaaaggcttacgtatgagtcgtcgcgcggtggatgcgcatgaattgattgaaaaattacaactcgaacaaccaattttactcggtaattcgatgggggccgcgacttggtttgcgtacgtgtcattgtatggtgatacaggaattaaggccctgatcgacgtggatcaaacgccgcggatgatcaatacaccgcactggcaatatgggttcaaacaggttcaatggcaggatattccggactattttagaatgccgctgggacactcgacgtttaagcacatcgatgatgcgacgtatgcgcgcgtcaaggcagtagaagcgcaggcaccgttcgatgcgaaattaatgtttccattgttggttaaccacgcggttcaggattggcgggatgtgatccgccaattgaccgtaccgttcttgatcattgcgggcgccaagtcaccgttcttcaatcccgactttgcggcagtgactgctcaaatggcactacgaggacagagtgtggtcattccggaagctggtcatatcgtgatggcggaacagtcggcagcatttaataaggcgttgttggaatttttggcgacgtgctaaacgaaaagcacttttaacacctgtattaaaggtgatattacagtcttgaatagtagtcatatcaagcaggtttagaataaaataatgtattatgttgtcttgaataacggccacatcaaaaacagtttcacaatactaaaaaaggctcaccaactaaaacaggttggtgagccttttcgatttattgactaattactaatcaatcacgccatcttttcccatccatcggaaccgaataaacttcccgacctcgatcacaatcaagacgacgatcccacagataatcgggatgccccaaccataccagaagttgatgctagtcgtatggaagacggattgcatgaatggtaggtaaatgattcccagttgtaagagaatcagaataccaatgatgtagaacgccatcttattttggaagaagtacttggaaatgacggggtggtcattccgcaagttgaagaggtagaaaatcttaccaaagatgatgatgttcagtgacatggtactaccgacgacatttggtaatccaagtgcggtcaagtagttgtaggcgaagatccccaatccagaaattaggaaggagacatagccgatttcaaagtaatctaattttgacaacaacccagacttaacattccggggcccccgggccatgatgccggcctcgggtggctcaaagatgaacgcaaactggatggtcagcgcggacaccatattgatccacagtaattgcgtcgggtacagcggaagttcgtggcccattaaaatactaatgatgacaacgaggccttccgcgaaactagttgggagtaagaagcgaatcgtcttacgaatgttatcgaagacgtggcgcccttcacgaacggcggcgacgatatcagcaaagtcatcatcggccaggaccatatcggcggattccttagcaacttcggtccccttgattcccatagcaaccccaatatcggcttgcttgagggccggggcgtcgttgaccccatcgccagtcatcgaaacgacgtgattattggcctgttgggcacgaacaatccgtaatttgttattcggtgttgcccgtgcgaagacgttataatcatcgatgtgtgcttgtaactgctgatcgtccatcgcgtcgatttcaggaccagtaatcgctttgacattggcggccaagttcaacttgttggcaattgccatcgccgtatcagggtggtcccccgtaatcattttaacttgcacgcccgcttgccgtaattcggcgatcgcggtagccgcttcttcacgaggcgggtcaatgattccgactaagccagctaaatgcagcccaccaatggcttgtgcatcaatggtagtcacgtcatcatcgacttcttggtaagccagcgccaccacgcgcaaaccatcggcggttaagtcgtccatggcgtcatcccagtatgccgtttggttagcttggtcagttaaacgcaggacagtcgcgggtgagcccttgaccattagtaagcgttgaccatctaagtcggccaggcgagcagaaaaacggaaggcggaatcgaatggtagcgagtcaacttcttcaacctcaggatcatgaccagtcattttacgatacagcgtcgtcaaggcaccatcggttggttcaccggtcagttcccagcgattgttttcgaagtgtagctcggcgtcggtcgtttggccggcaatcttaacgagccattccatcgcgttatcttggtgccagtcgactttgttgccattgagcttgagatggccatcgaagttaacgccaccattatcatcataaccgacccccgtcacatcaaacgtatgctcaggcgtcacgaccttagtgaccgtcatttcatttttcgtcaacgtcccagtcttatcggtgttaacgatatctacggcacctaaagtttccacggcggggagtgacttgacaatgacgtttttcttcgtcatctgccgggttcccatggctaagaccaccgaggtactagcgggcagtccttctggcatagaaccaacgaccatcgtaataaccgcaattagtaaagttggcaaactataggtatccatgaccattcctaataggaataataggacggctgccaccacgatggcgatggataagccaacccccagtgagttcagattacgcatcagtggggtagtggtttgtttgacgtcgctaacagactgctggatatgaccgatttcggtatcttcggcggtagccgttacgattccgacggccgaaccgctagtcaccgcggttgacgcgtaaaccatattcttacggtcagccaaagctggcgtggtctcagtaatcggttcttcttgtttctccacgggattagtctcccctgtcagcacggattcttggacgttaaagttatccgctgaaatcaagcgcatatcggcaggaaccgcgtcaccggcttctaagttgactaagtcaccaacgactaattcgcgggcgtcaatttccagtttttttccatcacggatgacgaaattcttggaaatcagcatttcacgaatccgttctagcgcgttgccagcttggcgttcttggacataaccaatgatggcattggcaataataaccagtccaataacgatagaatcggaatagtggtgcatgaagaacgttaagaccgctgctgcggctaaaatgtagataatactgttattaaactgcttgatgaattgaacgaaccgagacgtacgcttggtctccagttcgttgcgaccgttatgttgtaaacgttcggcagcttcagcagtgctcaatccattctcaggatcggtggcgtactttgcggctaaggctgattcatcaagctgccataagttatccgcatcgggagggttctgggtgtcgttttgctcttcattagaggttaacgactgattgtcatcttttatcattcaattcgctccttaaaaataaagttattaccggtgaggttctgtaaaatcacgacgtttattgcgtgttaaataggccaatttcgccacatcctttcttaattagcgttattataaataatattatatacgaacaatctaggtgaacgccattaaaatatttgacaaattcatgacaaattattgcgttagttgcaataatatatcagattttggctagtttgtcgctgaaaatgactggttttcctcgaattgttgggtaaattaaatagggagaacttaagatgacagataagttaacgttattgcaatatgatccaaatccaacggctatggtagggccagacgtggatggccgctttactgttccagctaagctactctacatattttctggtgatgattattttcaacaattcgtcactcggtatcatggtcaccgtttaggccaatttaataccattactaaagttagctgggtttatcaaatcggttatcgtggtcaaaaattggcagtagcgcaagcgccccttggttctccagctgcgacaatgtatttagagatgttgattgattttggtgctcgtaccgtcatagccgttggtagttgcggcgcattaacagcactaccagaggaacaattattaatcccaacggtggctttgcgtgatgaagggacgtcctttcattatttagcagcagctgattgggtgccactcgatccaaaggttatacaggtactcgggacaacattgacgaaggcttgcctgccatggcagatggtcaaaacgtggacaacggatgctttcttccgtgagactgtgtctaaagtcaaagctgctcgtcagcagggttgtcaagtcgtagaaatggaatgttcggccttagctgcctgttcggcgtttcggcaagtttcctttggacaattactatatacggcagacaccttagcacaactagagcactatgatccgcgacattggggtgcgggcggtgttcttgttgccattgaactagctacggaaagtttggccgcatattagcgaataaaaaacgagcagtcgatgactgttcgttaatagtggttaatccttgatggggtccttcattaataaccagagaatcaggtaagcgatgataccagggaacatgggtgtaattgctaaaacaacaaataatagccgggtaacgttagtattccagttaaaatgttcggcaattccaccaatgacaccggcaatcacccggtccgttgcggaacgatgaatatcgatcttcataagttaattcccccttaataatgctaactataatgtagcaggtttgattcaataacgctactaatttaatcggttggaaacggcgtagtggtaagaaccgtggtatagtaggtgatttcggtcaaagcttggtgaagtgcatgatcgtagcgtttgctcaggggcgcgttatcgataaagtgaccgttactttgaagggtttgtggtacgttaccaatgggcgttggtttagggaggacgaccattcctaatcgttggagaactggaactagtgcggccgccccaaattgaccgccgcgcatattgtcagaatatgagataatcttagccggtttacgggcgccttcgaatgccaaaaaatcgaaggcgtttttcaatccagctggcatcgcgtgattgtattcgggtgtcaggataatgtaaccgtccgcactagccatatcggtgagccattgctgctggttagcaggtagctcgcggtgcgggttcgccatcggtggctcgggttcatcgaaaaggggaagctgatagttggccaaatctaaaaattggtagtgaatcgtagaatgagtcggtaattggtcaatgattaattttagatggttaaataaagcgcggccgttagcctgtgaccgggtactccctaagatgattgcaattttaaacatagtgggacctccagatatttttattgattctaatgaatacaaaatgatagtatagacttaataatattggtatgcaagtatttattcacttgaattaaaaaggagatatttaaatgacaacaccattagttagtcagttgatgacggaattaaatcaatttttgacgcaggatagcgttgatgatcaagaaaaacgctgggccatgcaacaaacgactgatccgcaattacaagcggcattaaaacaactatcgacgacggatattaaaattattgcgtatctgggacggcgtggtgccagtcgagctaagtcgctaccggcaccaacggaactttcacaggcgacgatttctcgcggtttgactaaattatctcgattgaaattggccacgaaatatcgggatttgaccaataacaaagaaattctcgtgcgattgacgacgctgggcgaagcagtcgctgatttacacacgcaactggacgcggccattgctgctaaagcacaagccattgctgatgactattctgacgcggaactgagacgctttgttagcctaatgcgacggattcgtgaaattaaaatttagcactccggttaaatgagtgctaaattgttgcattcccacaaaatggtgttagtatatatatcgaaggtcaggaaaggtcaaacaaggatttgaattactgaccagtattaatagccaagtgaaattttgaaaggggattgttagtatggctaatactttaatgaatcggaacgatttcggcatgttggatccgtttgaacggatggcacgctccttctgggcaccattagaaaacatggatcaagtattgaagaccgacattaacgaaactgatgatcagtatcaagtgaaggttgatgtccctggtattgataagcaagatgtgaagttggattatcgtgacaatgtgttgtctatcaaggttcaaaaagatagctttgtggatcatgaagatcaagaccaaaacattgtgatgaatgagcgtcatactggcaccttgcaacggcagtatatgttaccaaacgttgcggcggataaaattacggcatcccaagctgacggtgtcttaacgattacgttacctaagacccagccgagcgcgaatgacggtcaaatcgaaattcaataattaaatcattaaatcatcagtaacaagtgagcggcccaccgataatcaaatcggtgggccgtttttgacatcaacaatcggtatgaattatgaccggtggttggtaagctgttggtttagctggatgactttgatgcgggcgagtgccatttcaattaaccatagaccgatataggctccggtgtaaaccaaggtatagaagccaaaccagcgaacgtttaatggaaaccagccacagagaatcgcaagtggggtcatccctaggtaagaacacagacaatgagcaatggtttgtttcgtaatcgaccacgtttcaatttcgaatagccagctactgaatgcccaaacttcaccaatcagaatccacaataatgtcgaaagctgggtggcggctaagggcgaggaccagtggctgacaaaagtgggattagaaggaaataaataggtggtattaaagaaggttgagaaccccaaggccattaagtagccgataacgatgcctccgatggcgccaatcaaaagggtgtgccaaagtcttttcataattgtgccgcctttctaatttgttgggtatagcgtcgtgatgcgtatgttgttgtgccggttgttaggttgacttgaaagctaccccatttggttaaggtaaaatttttaacacaggcgattcgcacaatttcactactagaaatacgtagaaattggtggggtggcagttggtccattaaagtgtgtaagtggctgtgaacgaggtaagcaccggtggttgtttcacaataaagtcgtttattggcagtgtaaaaacgtgacaccgattgaagtggcagcttaatgagcgagcgatcttgaaaaacattgatgaatcgtttcagagatggttaactggacgtgcatcgctgattccccccttaaatagcgattttgataagcttattgtagtgaaaaatgcggcttgacactagtgcttattgctacttggtcaactaaacgggctaactggtcaggaaatatgacaaaaaatttcccgggaaataattgtcactggtggtcgctaaatatgataagctaattaacggtataatacttactgaaaattagtgtcagttagatatggagatgacgagcgtggatgacgcagaacgtgaacgcggaccatggcatcgtaatttgattgttttatggttttgtacgttcgttgcgggaatggcatttagcgaaattatgccatttctttcattatttgttagtcagttgggtgatttcacgaaggcccagattacattttatagcgggttagcttttgcagctgattacgcgatttcagcaatttcggcaccactgtggggcatcattgctgataaaaaaggtcgtaagatcatgctattgcgcgcgtccctagggatggcagttgcgatggggttaatgggttttgtaacgaatgtctggcaactagttgccttgcgcgcgctacaaggtgtgtttgcgggctttatttctaatgcccaagccttagtcgcgtcccaaacgccacgtaaatatagtggacgggcgttgagcactttgatcactggtgccgttagtggtcaattgtttggcccagtgattgggggcttgctagcccaattgttttcgattcgaaacacgttttttattacggccggattattaatggtggcgtttttgttgagtctgttctttgtacaggaacacttcaaaccagtcgcacatcatcgtgaaccaggtgacagtcgcaatcctttagcagcgtttcaaaatccgcgcttgattattgtgatgttatgttcgacggccatcgtccaatttggaaacgcctcgattgcaccaatcattagtttatacgttcgtgaattgatgcattaccgtggcccgattacggttgtggccggaattatcgcagctttaccgggtatttcaaacatcttttcagcaccgcgccttggacgttatggtgatcagcacggttctggtaaggtattgttatttggctatatttttgcggtgattatgtatttcccacaaggcattgttacgagcgtcgtggccctcggtattttgcggtttgccattgggatttccgatggcgcactatatccagagattcaaacggttttgactaagaatacgccagtacatcttacctcaacgatttttagctataatcaatcttttcaagctattggcaatatgttcggcgccttgctcggtggtttggtggctggttggttcaattacaacgcggtattcattatgacggcgttacttttgttaattaacctaggtttaattttgtggttagttcctgatatttggaagaacggcaaacgggcagtttcctaggtgtttggtagttagtctattaaattggctagctgccttttttgttacttgtccttgaacatgatgttaattcagtgtattgttagtttcatgaatatcgaaataagcaaacaagatcaggctgatcagcaacgagtggcgattttcaaagcactggccgatgctaaccgattacggattatccgggtgctctatcaagcacaacgggaaatgacttgcagcgaagtgggggcgcaattaaatatcagcaagtcaaccgtctcttatcactttaagaccttgcggttagtgggtctcaccaatacgcgacgaaaggcacagacgaagtatctatccttacaattagcgacctttgaccggtttttaccggggttcttagcaacgctttagtttttttgctttttagttcgacaattatcgaactaaaatcttggaaagaagatgtcaactacttatgaccacaacacatcaacatagccgctatttaacacttggaatgatgttagcggcaacgaatatgcgtttaccaattacaatgatgccgggattaatcagttctttgaaacggacactgggtttgccgagctcgatggcgggattactgaccacgatcccattattgacgtttgccattatgtccccattgattgcacattgggggcggcgatttggcaacgaactgacaatttatgtcatgttgatctttctagccgttgggagttatctgcgggtcatcccaacgattgctgcccttttcattgggacgttactagtcgggattggcacggacggtggcaatgtcttgattccagcgattattaaagataattttccgacgaagattccagtcgcaactagtcaatacacgctctcaatgctattagtcggttcactgggaacgggactttcgggagtgttggcggcacactggtcgttaccactaacgatggcggtgctatcggtgattggactaattaatttggttgtctggttgccaaacttgaaatacaatcatcgcgcaccaacagttgcgatgaccgcgagtgatgggcagtcaacggcaactcacgggagtgtttggcggcggccgttagcgtgggtcgttacggcctttttcggcttgcaagcactagtctactattcattactgacttggttaccaacggtatttgttgcccacggcttctccttgattgtggctggcaatttagttacggtcatgcaattgagcggcctaccgatgtcatatttagtgccagcgacttctggtcatcggcgcggcgtttgggcaatgattatggtggtaggtgtcggttttattgcgggaattggtggtatcttactttccggaacgaatttttgggtggcagcactgtcctgcgtcttactaggattaggctctggagcagccttcagtttggcagtcgtcttctttacgcaaaaaacgaccaatgggtttgaaacggctgacttatctggtatggcccaatccgcgggctatttgttagctgcagtggggcccgtactattcggctggttaggcggtcaattaggctggggaccagtactctggttagctatcattctttccgcgttactagcattatccggcagcatcattttccagcatgcaacgatttatgagtaattaatatcacaataatgcagaacgagattggcccaagtcaatttcgttctttttttgaaactttatctttgccttagagttactctaagggattacactaatctctattcaattaaggaggccacagtaatatggcggttattcaaattctaacggtcgtcggcgtggcgatcatcggggcaagccttgtaggtgatcccactcagcaacgacagtcaaaaccagtaaaggagcaaaaataagatgacagtgttaacaacgatgtatcaactagcaaatggtgtcaacattcccaaagtcgcattcggaacttggcagatacctggtggtgaggcaacgtatcaagccgttcgtgcggccttagcagcgggatatcggcatattgatactgcactggcctatcaaaatgaagcaagcgttggccaggcgattcgtgattctggcattccgcgtgagcaaatctttgtgacgactaaattaccggccgaaacgaagtcatatcaaggtgcactaaatgatttcgatcgctcactgaaaaatttgggcttagactacgtggatctctatttggtacacgcaccttggccatgggggcaagtcggtcgagtttacgatgaagctaacctcgatgtttggcaggcaatggaagctatttatcaaagtggccgggcgaaagcgattggtgtctctaactttgctgttcgggatttgaagaatattcttaaccaggcgacgataccaccaatggtcaatcaaattcaatattacttgggcttcacggaacctaagatcaccaagttttctgaggaacatgccatgcttgtagaagcatactcgccgttagcgacgggcggggtcctcgataatccgcaagtacaggcctatgctgataaatacggcgtcagtgtggcgcagttagcgttacgcttcgttttacaaaatggggtcttgccattgcccaaggctgttaatccagcccatattgaggcgaatacgcaattggacttcgcaattagtgtggccgatatgcaagccttaaacgacttgccagatgcggctggttcatacatgcacaacccaacccaaggttaacgaacaaaatgtttgaccgcacttgggtcgataggagtaaactgaacataattaataaacgataaggagcgatttgatgacaacgattaatgcagctaacgcgggtacttacgcgtttgatgatcaattcaaagttaaccggatgggttatggcgtcatgcagttaacgggtcctgggacatggggaccatacgctgatcctgaaaatggggtcaaggtagttaagaaagcactggaatatggcgttaatttctttgatacggctgattcatacggtccatggtttgctgaccggtacttagcggcgggcttgaaggatgccgctaatcgtgatcagatcttcatttctgataaggtcggtcaaacgcggcaaggaccgaatgtgtggacgccacttggtgagccacggtatctgcgtcagcaagtagaagtttcaatgatgacactggggattgaccatgaagacctagtattcttacatcgaattgaccctcattactcgattgcggatcaagtcggtgaactcaaaaagcttcaggatgaaggtaaaatcaagcatatcggtctgagtcaagtaactgttgatcaaatcaaggaagcgcagcaagtcgctaagattgatgccattgaaaatctctataatgtcgccaatcacggtgatgatgacgttgttgactacgcggcctcacaaaagatggcttttctgccatggttcccattagcaacgggtgaactggctcaggctgggagtgtcctcagcacgatggcccaaaagtatcaggtgagcccagcgcaaattgccttggcttggctattgaagcggtctgataatatcataccgattccaggaacaagttctattgagcatttacgggacaatgtggcagccgccaacgttgatttaacaacggccgattttaatggattaagtcaattaagtgttaaatgagtatttaggtcgggaattcccgacctttttgtttgcctaaaacgagctaaacgacgcttgaaattcatggggttgacggttaaaatgaataaacattgaatgagaaagaggattgagcaaatgagtacgcgtttgatgagtgatgagccaacaatttatttagcaggaccttggtttactgagggccaaccagaacggctagctaagatcgaaaaattaatggacgagttagaattgacttattacagtccacggctagacggcatcgatttgacgccggatgcgaccgaagctgatcgaaacgcggtatttacggacaatgtggaccatttaaaacgggccaagttagttgtcgccgtggttgatggctttgacacgggaactatttgggaaactggaacagcatatggtttagatatccccgttgcttactatagtgaaacgttagctgatggcacgtttaatgtgatgctggctaagtccggcaaagcggttattgagaacatgactgatttgaaggcttttctacaagatcccactgccgatgattttcaatatacaggaactattcgttaatttgaacggttagtcaaaataaaaagtgagccgtctgcatttgttaaggctcgctttttgcatacataaatggcagaacttgtggtgggaatgagccgcttgaaaaaatgtaatatttgttaaaggcaatgtgtttaattggagaaaagtcatcaaatggtgttacgctatgggcagaaattggttgactagcgcaaatattaagaaagcggcaagaaaacaaaaaagttcagttcaaactagacaatcactatccaagttgtataatgtacttgtaagcgttatcagaacctaattacctattttgggggcgttatttatggttaaaagtaaagcaattatgattggtgccgggctatcaaatatggctgcggcggtctacttgattcaagagggtcattgggatggtaaggacatcacattctatggtgttgatatgcacggtgccaatgatggtggtgccacgactgattttaccaatgagtattggaataagaatcatccgatggctaacacgactgggtatgttgcccggggtggtcggatgctgaattaccggacgtacgttgacttaatggatttattggaccggattccatcggtaactgaaccggggatgacggcggccgaagatacgcgtgattttgatgcgaaacatcggacgtatgatattgcccgcttgatgcagggtggtaaaggcattattaatgctggtaagttaggattcaataataaggatcggactttgctgactaagttgattatgatgccagatagtgaagaaacgaagctcgacaacgtttcgattgctgagtacttcaaggatgatccgcatatgttccaaacgaatttctggtatatgtgggaaacaacctttgcctttagaacgcaaagctctgctcaagaactgcggcgttacatgcatcaaatgatttatgaatttacacaaattgaacacttagttggtgtcaaccggacgcgttacaatcaattcgaaagcatgattttgccattaattaagtacttgcaagggcaaggtgtgactttcattgataataagattgttaaggattggcaatttaaagacacgccaatgcaagacgaaattacggtgactggcttagtcattgaggatgcgcagactggcgaaacggaagaagttgaagttgatgaggacacagcggtgatcttcactaacggttcaattaccgattctgcaacgatgggtgattacaacacgcctgctcctgaaaatatggattatggtgttagtgctagtttgtggaagaaggctactgagcggttctataacttagggacgccagataagttcttcaacgatcggaatgctagcgaatgggtcagcttcacgttgacgactaagaatcatttattcttaaatgaaatcgttcggatcaccacccaggaacccgggaatgcgttgaactccttcttatcaactacgccaattacgccgttgaaccaaaaggatgttaatatgtcgatcgtggtgcaccaccaaccacactttacgacacagcaaccaaacgaaacagttctgtggggctacttcttgtatccacggcgtcaaggtgagtttgttaacaagccgtatatcaagatgacgggtaaggaaatggctcaagaattaattggtcaactttccaaagtagatccgggtccaggcaatattaaggacaaggaaaaggaaattttggacagtattgtgaacaatattccggtatacatgccatatgcttccgcactctttaataaccgggctaagtctgatcggccagaagtcttaccaaagcactcaacgaacctagcctttacgggtgaatttgcggaacaaccataccagatgatcttcacggaacagagtgcggtccgctctggtgagattgccgcttatcactttgctggggtcccaatggataacttggtcaagacaccacggtacgataaggatccaaagaccttgctcaaggcaactaagaagatgtttgattaattaaatgctggcctgtcagtggttaatactgatgatggcatgatttaaaaacgctccccatgaaagatgactttcatagggagcgttttagtgtgcatcacgatcagtagtgacggctcgttgagacgccgtcattaacaggatcaggttgctaagcaatttagtggttgatcaaattttagcagctgctttaggtgttaatttagacggtgtgtgtttagtagtggttttgaccgtgagatgctttttggttgcaagtttgggcgcctttttagcgttttgcttggcggtctttttgattaattttggtgccattttcttagttttcgttggttgggctaacgtttttttagtggcgagagtcgttacctttttagttggtttgatacttgccttagggtgcttgatcgttagcttcgttgattttactttggtggtcttcttagcaatcgtcaacttagtcctcggggttttcttggtcgcttttaatttagcggtcggggcgttccctttaatcatcgtggtggctttagcccagccgagggccttaccgtgttcactaatgagataatatgtggccgacgtatgcttgccggttgctaaagtaatcgtcttagttaccgtgtaagtctttttagtgctgagttttgctttggccgggctaacaaaggcgattgcccgatcggcggcaaagtgaattgtattcaaagtcgtggcggccttcgcgtgcattgtgatggcgggaaagtgggtcgctttagtaagtgcatgggtagtggcttttggggttaccgtggcggcattagccgtggtagtcatggcaaacgggctggcagccaatggtaatgccaaagcaagtgttgcaacgactgatgttaattttttcatttcaaaatcccccttaaagtgaatcttttttgattcgaagatagtttagcaccttgactgctttgcaacaatcgtaatatcaataaaattatcaaaaagtgggtgaatttgaatgcaatcaataaaggcttgataacaaacgaaccgcggtgggagtaaccgttgggttaatgagagtgaccgagattttagaactaacgttcgcactgaatgggaaagttatggtatgctagaacggtatttttactgaaaggggtgggcggcattgccggcagcaacaactttaataacccccgctgaaaatcgtttctttctgttaagtgaacgagctcgacggcggaccacgctccaacaaattagtgcgttattacgcgcacacgtaacggtaaaggctgacagtgatttcttgaaaccgactgttcgtaacttgattttacaagatcatgcacagtggttgaccgactgtagtcatgagtggcaacttttggcgagtctgccgtacgttgttaacccgaatgaaagccgacaagcatggcatcattgcgaattgtgtcataagccggttcgttatgagtaccatgttcaaaacaagcataatcatcgtgagttgattgtcggttctgaatgcgtcaaaaagttcatgaacgccgaaacgcgttacttgatggtgattacaacagaagataacttttatgcggtggcccagtatcagacgctgactaccgctgtaccaacagtgccaacgatcatgtttgctcagccgtggctaccacaattaccggctgagcaagcgccccaagcgcgcaagttgcgacaaacaacgacgcaaaccgtcacgacgtacctaaaacgtcgtaccaagcagctaccattacaggaactaaagcccgctgaacaaacctatcagcggttagtccatgatgaacaaacggtgattgaagcggctgagcgggcggcccgtcaagcaattgtgactaatcaacaacaacgccaggcacaagcgcagcaaagtgctgtgaaggccgagcaaaccttgcgccagagtcacgcctatcaatgttatttacagcagctggcggccattattgtgatgcgtccggaacgaccgatggcgaagcaacagtttgaaaaaatcacgccaccagcgaccgaacgccctttggtgaactcttatcaattcgggcaaatggtgactgaatatcgacagactgggaagattcaagttcggcgcctagccatgcttgatcatcagttcgttgccgcacttaatcaggtgactcaacagctagatgaacaacaaacgacgcgtttttatgacgatgtcttcaatagttgttggggctggcagtatcatcagcaggcgacccaacgtgcggattgggagcacttattgacgacccggtggggccaatcattgtcgctggcttggtttgaacaattagccatgcaaacgacaatgccacaaactcaacagtggcttgcggacaatgcggatgccggtatgcaagcagcactacagcaacgtttggctgcgcatgaagaccgccaaccgattgcccgtgaccggatgactagatcggaattacgacagttttgtttgcgtgaacagccagctgcgccgacattagaagcatttgaacaggtctttgaccaacagtatcaattgcccgtcgaccggcaagtaacggcccatgaaacgttagcctattactatattgcgcgtcaatatcaaggtgaccatcagcgtgcgttacaacaactgaattggttattgaaagtctaaatgtttcacgtgaaacataaaaacgcccactgattttttcagtggacgtttttaattcggctgacaggttaactattaatgacgctgtgatagcgcgaggctgcaaattcatacagcggccggctaagtggtgtgacctcaacggcttcttcaaatggtgccgtaaccatggtgttgtcagcgtttttagcgagtttgacggcccaagttggatcataaagtaattgttggcccactgcgactagttcggcagtttgtaacacagtcttgacatcgtcgcgggtccggacgccaccaacaccaactagtggcaatttaccttgtaacgcttcgtgcacgtaggtcatgatggatttatcttgatactgcgggtctcgtgaaacacggtcatagttgttgagtgagacatgaacgtaatctaatcgactttcccgtagttgtgagagtaaccaaagggtatcttcaagccgaatacctggttcttcgaattcttctggtgagaaacgatagccaacgatgaagggccggtccgcatattggtcaacagctgcaaagacggcctttaataattcatcaataaagcggaaccgttcttgcggcgtgcgaccaccgtattcatcggtgcggcgattactatgtggtgagaagaactgttggatcaaataggtattggcaccgtgtaattcaatcccatcaaagccggcttgaatcgcgcgccgagttgcttcaccgaatgctgaaattgttgcgtggatctcgtcaatcgacattgctcgcggtgtttccgcatcgtcacgaagggccgcaacggcactggcagagacaatctgttcgccatttaagacggctcgatgcgtcattcgaccggcgtggaagatttgaacgatagctttggcaccttgactttgaatgccatgagcaagtgcacttagaccgggcagcatcgtgtcatgcgcgatactaagctcgccatgccaacccttaccgagatcttcgacgttggcagcacccgtaatcacggcacctaagccagtagctcgttgtgtgtagtagtcgatttcgtcatgggtgatactaccattgtaaaagctttgagtcgtcgtcatgggcgacatcattaggcggttgcgtagtgtaacgccagatttgaatttgagtggttcgttaaaactagtcacaataaaacatcctttcaagctagttttgcttactttttgtaagatctagtttcagtttagcggttgaaatttgttttttcaattttaaagtcgctggttttagttaatcttggcataacaggatggtgcgtgtggaataaggggattgttgctgttgttaagtcaggtgaggcttgataggtagatgcaaacaaaaaacttcatcgataagcatggtcgacgaagttttttggaaaattatgatgcaacgttatgccttaaacggattccagaaacggccaccgttgaccttaaagagggcgatgccgaggatgatcagcagagcaactaacgttaacgccagatagtcgttacgtttaaagcgttgggccatgtaccatgtgcgatgttttcccttaccgaagcgccgcaattccatcgcctgactaatggtttcgattcgatctaagcttgaaaaaatcaatggaagcagaatttggatgccgccacgaatacgggtcataaaatgcgcttttttcgacatttcaaacccccgagcctgttgtgccagactgatagtacggtaatcagcttgaacgtctggaatgtaacgtagtgcaatcgctacggaatagctgatacgataagaaattccaatcttattgagactcgcagcaaattcgctgggattagtcttcatgagaaaaatcagggcgagtggcacggcaaacgtgtactttaataacaaattaaattcataaaaaagttgttcggctgtcaagttaaagtagtgatcagcagatcccagtagtaagtgttcggtaccataaatcgagacgccgtaatgaggcgcaaagacgtacaccatcactaagtttaaaacggaaaaaccaataataacgttaagcacgaacgcgatatcgcggtaatgaatttttgaaaagcggaatagaatcagtgaaaaaatcatcaccccgattaagtaacgcgtgtcgtaagtcatcatcccgataactgataagccaacaaagcagagtagtttagtgctaccgctaagtcggtttaaaaaagtatgacggtcgttgtacccgatcaataattcatgttgcatcttagcgcgcctcccgttcagcctgaacaaattttgcgacgaattctgtcgggtttaaatggtgcgcttctgccagggtgtataaacttgtcttggctaaggaagcttgctgaatgatggatgcgttggtcaacacatcggctgggcgagcatccatcaaaatgttgccgtggcccaacacaatcgtgcgatccgtgtattctagcattaggtgcatatcatgcgtgatcaacataatcgtcatgtgttgttcctgattgatcttagttaagaaggtcatcatttcagtatagtgttgcaagtcttggcccgcagtaggctcatcaagaattagcatggccggttctaatacgaggatggccgcaatcgtgacccgtttcttttgaccgaaactgagcgcagaaataggccagtggcgaaactcatagagaccacagaccttcagaacggcctggacacggcgctttacttcatcgtcagcgacacctcggaggaccaaaccggcagcaacttcatcaaaaatcatcgttttagagatcatttgattggggtcctgaaggatataaccaatttggtcggcacgttctttgactgattggtcagctagggaatgaccgttaaatcgcattttgccggactgtggcatcaaaaacccagtaatcagattgcttaatgttgacttaccagtcccgttttgacccactagactaatcatttcaccctgatgaagtgtgacggtgatatcgttgatgattggtttggcgggatcgtacccgaatgtcagatgctcaattgcgagtaacggttggtcatgaacggtgggcgactgtagttgtacgccggcggtccagttttgcaacgtcgcggtgaggtcgggtacttgtaaggcttggaggttatccaagtgttggcaagttgctagatcaacaccggctagtttgagcgctgaaaggtataatggttcgcgtagcccgagttgagtcatgagtgattgccgcaaaatcgtttccggccggtcgttagcgacgatcgcgccgtcttgcatgacaatcagccggtcgattggttgctgtaacacgtcctcgatgcggtgctcaataatgatgacggtcaggtcctgcgtatgagtcagctgatcaatgagtgccatcgaggctttacccgatgccggatcaagactcgctagcggttcatcaaataataggattttactattgtcgatcagaacaccagccatggcgacccgttgcttttgcccaccagataattcctgcgggcggtgagtcaataagtcctggaggtttaaagtttgggcccactgttcagttgcttgtcgcatggccggttgggtctgctgatcattttccaatgagaaagccatatcttcgacgacagtcaaaccgacgaactgactatcaggatcttgcagtaccgtaccgacgtcttgggataatgcaaaaatggagctctcagtaatggtttgaccagcaatccttgcttggcccgtcactgttcctggataggactgcggaatcaagccgttcaaacaccggcctaatgtagatttaccggagccagaaggtccagcaatcaacactttttcaccggggtaaatatccagattaatatcacgtaaagttggttccgtttggctattatattgaaaagagaaatttttaaagctaatgatgggtgcgctcatgttattaacgttcctttgttaagctcccacgttgggtccgcgtccgggcgtacaagactagtaggatggtcccaatgatggcaactgagatggaatcggcgatccaagtaatgacaccttgaaggtaaactttgttggccggttcatgataaataataatatcaccagttggtgctaaaagcacccaaccaataaagttgacgatgatttggtaaatgttaaaccagactaattttgccgttcctagtacgccattttcaatcttgagccgatttttagctagtccgaaggcaaccccaatcagaccatcaacgatgacccaggtccaccaaggcgaaccataagttacgaagtcgtttaaggcgtgaccgatgaacacggctaaaccagctgcaacgggaccaaagatggctcctagtaaggctaaaaaccccatcgcgacgttaacctgggtattcggcacacccgttggaatggcgacaaatttcatgagaacaaaaataacggcggcgccgatcccggtagccacgacggtacgaattgaattggattgcttgttttgcatagtgtaacactccttaagtattgagaatgaataagttctaataaccattaataaaagcgaacaggcgttaatttcagatcagttatggtcataaaaaaacgcgcctaaaagcgaatgctttctaggacgcgtttgcgtgttaccaccgagattttcccacagggacttatcatgatcgtaacggatcgctccgactgagatggccccagtagcttcttcaagaccatcttcaactaaccacgtcatcgttttgcaccaaaaatacgactctctaagcacgagaattagcttactcatcttgtcacagctttttctaatctgaatttaactattaaagcatacgccaaagtctgtgggggtgcaagtaaaaccgaacggatgtagccggttacatcgagattgaacgggaaaatcgggaacagctgattaaatggtggtcaaatgcgctgattcattcggctatacggtcagtgacggatgctgatgattagttggattggtcgttaattaaacaaagccaataaaagtatatacaaatgatttcaattagctactaaaaggggtaaactagttgacaagaccaaatgatgaaggggatgtgagtagtttggcttataagtatgaaacgattgcggatagtctgcgacaagacataaaatccggtaaatatacgccgggcgaattgatgcccgaccagaataaattagctgaaacttttgatacgacacgaattacgattcacaaggccattcaattactgattattgaagggatggtttactccaagcgtggcgcggggacctttgttcgcaaggactttggtttgactgaacggcgccaagaaacgctggtagacaagcccctgggaacaacgcaaacgaatgccggtaaaaaggtgacgagtaaggtgttggaattacaagctcgcttgcctactaagcgggaagcggaacagttgttaatcgatgagatggatccggtgtacgttattcggcggacccgctacgttgatggtaaggtgtgggcgtatgagcatacgattatgccaacgagtatcgtgacgttgacgaagcaagtcctcgaaggctcggtctacggttacttagagcaacatagtggcaagaaaatcgcgggttcacaccgtattatctcggcagcccgagtgacggctgatgacgttgccgcaatgggcgcgactctgaatgatcccgtgttggtcattaatcagattagttacatggatgatggtcaaccctttgaagtctccgaatcacatttcccatacgagacaagtacggtcgtagcggatgttcaaattcattaaagcaatcggtaaccgcgttaatcagtggctaccgattttttgtggaaattattctggggagttgcattcaagaaaacggtggcccataattaaattgattgaaaaagaaagcgcttcaataatctgattaagggggatgaaaatatgccagctaacttttatcaacgattaattgataagtatgaaccaatgacggaagcagcgttcttagtgttagtcagtgttcgccagccgattaccagtgaagcgattccggcaaagatcgctgaaatgaccaataatcaactacagctaggattgggaaccttatttacgaatttgcatgccatgactaaggattatttaatgacggaacgagtcgatgaaaatgacgtgcatacctatgaaatcacggggagtggtgaatcggttttggcggctgaacgaaaacgactgcaattattgaatcagatttgtgagcaggcgggattgtaatgggttaatttaacggggaagtgagtatatgtggcgttatcaaatggcagtcaaaggctctcagagcaggaattgcgatggctcaatcagcaggtacaacgcgggcaattactgcggcgtatcagggggaactggtatcaatttcaaaaaacgacgacgcggtatcaagtctttagtgaatatgtgagcggtaatgttgcaactgaaatcgacgaccagcacacaccgttcaaattgttagcacggctacaattgacgaaaccagccgtacaggtgatttatacgggcacggctcagactgagttgcagggggcacgagtggatcgtcaggacgcaccgttgcagttgaaaattgcactggcgcaacggggacacttgttaaatgtcatgaatattaggttagtggttggtctgatactggccgtgatcgtgattagcctgaatgtgagtgataacgtggccagttggggaatgctagcatggttgctatttaccttctatcctgcatggcaagcaagtcggctgcataaacaggcgaatgcgctgcgagtcattacgcaacaatatgatgatgcttggcggccaacgatgcacgttttcttgaaaaacatgtccactgagctggatacagaaaaagtggcaggtctaggggcgtgggcttacgtcggtcaagatcatcacgggatgtactggtatgacttgaagacgctggcaagtgctgcggaaatcaagcaatcgctacagctaattgtggaagatagcgtttctgtatcgattgtaagttggctgggattggcaccaattggatttgtttaaacttttaaaatggaagtggtaggtatgtggcggcatcgatttttgatcaaaggttctgaacaggagttggcatggctgaatgcgcaagcgcagcgacgctatttattgatggctattcatggaaattggtatcagtttaaaaaagtgccgacggtttatcgggtctttagtgagtatgtgccgcaagcaatcgcggctgacatgagcaacagtaacagcgcgtttcaagttctcgcccaagtgcaagtacagcaaccagatgttcagattgtgtataccggcagcgaccaaccagcattacagcaaacgacaatggcaccaactgatcctaagattcgtttgcaagtagctttgcagttacgtgatcgggcgatgaatacgatcaacctcagtctttatgcaggggttgtggtatggggattgtttttgattctgatccttcatcggggtgatacagatttaataggcatctggatgctaatgctgttagtaggacttctcgcggtattaggactgtatcggacggcgcatcgtttgcagaatcaaatcagccagttacggcgtgacactgaacagtacgacggggcctggatgccgacgatgcacgtttttgtgagtgcattgactgctgatcttgacaccgagaaaccggcattaaagtcgttaggtcggtggaccttagttggtcatagtaaaaagggccagtattggtatgatctgcaaacgctagccaatgcgatagaaattaagcagactttacgaccatttgttgcgactgacactaacgttaacgttctgagctggttagggctcgcgccactgggctggtttgtgtgattggcaataattgtttgtacaattaacatataaaacgttagactattctgagactaacgttttttttgtgtttaccggtctgatgataatataaatgataaaaagtgacatataatcataatagtagtattctaaataaaagacaaagctggaataggttgagtgttagttaatcagctggaaattaatggatattgcgcgaattttactataaaagtttttttattcgtcacaaatatttcatataatcgggttaacttaaatagtacaagctcgattgtgttgaagacaattgagctgattacacagaaagcttagtgaggtgattttgatgcgacttaaggatttaactggtgagactttcagccgtttgaccgttatcgaacgggctgaaagtgcgccgaatggtaatgcacggtggttgtgtcagtgttcatgtggacgacaagtagttgtcgatagttatcggttacggaaagggattacgaagagctgtggctgtttacgggcagatgttagtcgaaagaatatttttgaaaatccgcaaacccgtaaaaatatgggacgtagtgataacttaccgctttatcaaggaacttcggtcgatcgattgaaaccgaatagccggaatcggagcggggtcattggtgtttcctttgaccgatgctcacagaagtgggtcgcacggttaatgtatcggggccgcttagttttgaatcagcagtttgctgatatggatgatgccatcatggcacgtaagcaagcagaacaacgctacgttatgccagtgttagaagaatatgcgaaatcaagcgcggattaagatgcgtacataattagcatgccaggagactggtgtgctttttttgcgattattacccgggaaataaacgagttagattaatacccgtgaggaccgattatttgtgtttattgatcaaactagttagacttaacgagcaatttaaattagaacggaggaactttgagcatggaaatgggattagcagggaaacgggtcttggtcactggttcgactaagggaatcggacgggcaattgcggtagcatttgccaaggaaggcgcggatgtggtcattaatggtcgccgcacagatacggtggcagcggttgtggatgaactcgcagcggcatacccaacaactcatccagtggcggcaccgtatgatattagtgatccgcagcaagctgacaaaatgtttcaacaaattccaacggttgacgtattggtcaacaatatgggaatctttgggccaatggcttacgatgagattgacgatgcaacttgggaacgcttctttaaagtgaacgtgttgtctggcaatcggttggcaaaacattatttacctgcaatgttagcccaagattttggacgcattatctttattgcgagtgaagaagcagttatgccttcgggggaaatgccccaatattcgatgactaaatcgatgaacctttctttagcgaagagtctgtcgaagttaacagttggtagccacgtaacggttaacacggttatgcccggctcgacattaacagaaggtgttcagaaaatgttagatgatatgtatgctgattcagatttgccaaaggatcagtgggagcatgactttatgattaatcatcgaccactatcacaaattcagcgtttgattcggccggaagaaattggtcggttagcagtgtttatcgctagtccgtttgctagcagtttttctggtgaagcattgcgggcggatggtgggttagtcccaactatcttctagtggctaatgaagacgatatatctttctggttctgccatagaaattcagatgtcaaaaaactgttttagcgagtaaagtttatcgccaaaacagtttttttgttgacttgactagcctcagaagccagtttcaagcggattagatgtttaaaatgaaatttttaactgattgactggctagtcattgacttactagtcaacggcgcctatgattgcagcatcaacaataagatgctcgaatttgaaggatgggagtgagtcatatggataaagaaccgttattaaggattagtcacttgcaaaagcatttcgggaagtttcaggctctcaaggatattaattttgaaatcaacgcgggggaagtttttggatttatcggtccgaatggtgctggtaaatcaactactattcgggtactacttggaattttaaaagctagtggtgggcaggcgacgatttttggtcgcgatgtctggcaggatagtgtggcgattcataagcgaattgcttatgtgccaggcgatgtttatttatggcctaatctaagtggtggggaaattattgacttgtttcttaaactaaacggtggtcagcatacggctaagacggacgcgctaattaaacaattcgaactggatccgcgtaaaaaagcgcgcacttattctaaaggtaatcggcaaaaggtggccttgattgcggcactctcaacggatgctgatctatatatttttgacgaaccaacgtccggactggatccgctaaatgagcagacgtttcaaaatgaagtattggctttaaaacggcgagagaagagcgtcctgttatctagccatattctgtcagaagtggaaaaaatgtgtgatcgcatcggtattatccgtgagggacagattgttgaaacggggtcgttagctgagatgcggcacttaacccgaaccacggtcgatgtgcaaacacgactgcctttggctgacttgaccaccctagctggtgttcacggggtcacagcgcgccacggagataaccacgtcagtctagccgtcgatgctgaccagttgacgccggtagtgcagtacttggcgagtcggaaactgatcagcttaacaacgaccccaccaacgttagaagatttattcatgcgctattacacgaccgaacaacaaccggtgaaggggaagtgatgctgatggcaacacaactatttgctcgtaccggattactgatacggttcaacttacgacgagattggaaaaagttgctcatttgggtcgtcgtgttgacggggctattcacggccatcgccgcgaagtttgatggtatttatggcactcagatggcactgaatgaaattgtcaaaacgcttaaaacgcccgcgatgatttccttatttggtgcgttttcggccaaatcgccatatacgacggccaaggtgtttgcaactgaaatggtggtttttatggccatcgtcatgattgtgatgaatatcatggtggccgtggttacgacgcgcggggatgaagatgatggcctgctagagctagtgcgtgcccacgcggtcggtcggttagcaccactattcgccggggcagctgagttaacggcgctaaatggtttgattggttttctttttgccctcgggctgaccgtcgccaagcttccgggagcgacgacgccaggtaattggttaattggtctgggcttagggggcttaggctgggcttttggaatgttgacgctgttacttgcacaggtaatgactagtgcgagtggtacgacgatgctgagctatttgctactgggcgtcatgtacgttgcacgaatgggcacggatgttaaccgtccagacctgacttggtggatcccctttggttggattgaaaaattagatgcgtatcaaaccaatgattggttaccaatcggtctgtatgtattactgggtcttggttgtttaagtttggctgcagctcttaatgcttatcgggacttgggcgcgggcttagtcgaatcacggcgcggtcggcgacaggctagcggtttgttgcggggtcccgtgaccctattatggcggcaggcacatggtctgattattgcatggctactagggaactttatcttaggtgccgcgtatgcgtccgtctttaatacgattggcgatctggcaaagagcaatccaatgatcaaacaactgctaggtgcgttagctttagcagcagcgaatcgcttgatcgtcaaaaatttcattgctgtgttggctatcgtcatggtgatcgttgcactggttccagcagtacagttaatgctcaaactggtcaatgatgaacaaaaaggctatctacatcaagtttatgcgacggccacatcacggtggcacgtgtgggcaagctataccggctgggcaatcgtaacgggactgctcgttttacttgccggtctaagtggtatgtatttgatgggcctgacgagtatggtcaagcccatcagttgggtgacctattggcacgtgtttgcggcctatgcaccggcgatgttagtgatggtagcggtgacgagtgccttagcgggctggcgacctaaatggcggtatgctgcgtggatctgggtattttacgccttcttctcattgtatcttggtaatttgattgatttgccaaaatgggcacgccgtttaacgccccttggctttgttaacaaggtaccaatcaagcccttagatggaacgacaagtagctggtgcctgttattaactgtgctaatattagtagtagcagcactaagttatcggcggcgtgatctagctcagtaaacgaaaggagtgcgtgacatggcagtaaaacaacctgttcctaaagacccggcgaaggtcgagcgtattatgcacgcggccatgcacacctttgccgtcagtggctatcgagatgctaaaacggatgtgattgcgtccgcggcaacggtgtctaagggcctattatttcattattacggtagcaaacagcgcttgtatttggccactgttcagcttgctactgacacgattattgccaccattaatcaacaagtttttgatgttccagatgacctagtcacgttgatggtgcggagtgcgcgttacaaggcggcgtttggtaaagaccacccggatgaaatgaaggtcttgattgacgcgtatggcgcgctggagcgcttgccggtaaagatacaggcacaaatgaagatcctgtatactaagtcgatgactatttcccgggaaatgatcagtcaggtgctggataaaatgacgctgcgtgcggatgttgatcgtgatgcaacgattgctttgattatgggtgtttacaatcagatttttatggaatttcagacctatatgcgtgagaatcatcaagttgaatcgatggccgatatcgaatgggtggtcagtcgcgcaaaaacctacatggcgattttagaacatgggtttatggcggcagatttagatgaccagcagtaataatacgtatttcaacagtcgacggatgtttaatccggacgactgtttttcgaccggtggattcggcagcgttcaatagtgataatgtttattcgcttttttcgttagcaggctaaaaatgtggtaagttagacttaatagatgacggatgaagtgagggatcggaatggaattacatttaacggcacgacagacgggattgtggcaacggttgatggcactggcacgtgagcaattgatgggactcgccatgcagatggagtcgactgggaaagtcgatcgaccgacactgacaacgcttgcccagcaattggctttggacgatccactaccagatgaccgcctgagccaacgggttttgagtacattagcgctggcgcaaagttcagctgggctcgctatgagttttgccagtagttggcaagttgaggatgcaatattaacgtttggaaccccgcaacaacgccaacggtattgtgcacaatcaggtgtttttggactcgcggcattaccggaacaagtcatggctagtagtaccgtcaaagcaacgccggtaacagctggctggcaactgtccggtgcggttaaaacggtattgaatgttacacaggcaactgagtatttagttctcgcacagacaccaccgaatgctacaggggcctttgttattagtgctgatcagccaggcgtcacggtcagccaaccaataacccctttagggttacacggattgaccatcgcggatgttcaactcaccgatgtcccggttacggccgctgatcaaatcggtcaattgggacaaggacaacgagtgatgcaacgggcgcaaagcttggggcaattatttgccggggcgattacagcgggaatatggcaacatgccacagaccaggcacgacagttagcgctgacagaacagccgccgttaactgccttggcgccagcaatggcgattacggccgccttacagactagtgtctacaatgcggcccaacaggccgatgatgagcgcccatttacagacgcagcgcaattggcggcaatgtttgccagccaaaatgccttggcgccgtttaaaattttgatgccattgatcggtgatctagcctatacgcaacactcgccgttaagtgccttgcaaaatgacgtggcgacactaccgttgattgttggcacggatacgcaattggcgttgacttttgccacgacgagcctgaatgacgaagtggccgatgtcccgacaacgggaccccacacagctcctgagcacctagtcgtggccgacctacatcgggtcgtaaaacgcttgaatttgactagggatgtgccagtcaatgtcggcagtattgctacggcgaaacgcgtcgtggcattaggtcgaggcgcgatggaaccggcagtattgcttcaagcccaacaattggccaagtggattggtgcagcattggctgttacccagccgctaacggctatggaacaatttagcattgagcaacaaattggtgcctcagcagtgacggttgcgccagaagtcttgatcaacattggcgtcgctggtgatgatgattacttggctggcatggctggtgcgcaacacgttctttctgtgaatacggatgaacaagcgccaatcttcaagcattcacaacaaattttcgtgggctgtgccgctgaatttttggccggaatggtggcagcattaaattaatacgaagtcgagttcggcactgttggtaggtctgacggggtcgtatgacaatcaattgtttgcacaaaaactaagggtcacagcaatgtactgtggcccttggttttttacttagctttaaattaagtaccaccagtcattacttaattaacgaaataattaatgactgccgtcacttaaagcgtgcggtgagctggttcagaatcggaatcttaaatagggcgatcaagataactgagtagcagacgtaggttatgacttcttgtatcatgcgcgttgttagcaaaacggaccatggtgttaagtacatgagatgaagccagaggctgtttagaaacaaattgagaataaagacgacgataaagttagcgacgagaacgcgtgtcagtgaagtttgatgttgaaaggcgtatccaaagactaacccggtcagaaaagcggttaggataaaaccaggaaaaaaggtgaactttgggaagagcagcattccgagtagggaggaaatcgcgctactgccggctgtaactagtggtgaaaataaacgggccgttaaaccaataataataaacgcgaaggatatcttggttagcaatagttgaattgacagtaaacttcctaagataagttgcatggcaattaaagcaccgagtaacgggatacgccgaaccgtgagtgatgatgtcataataattgaagccccctaagtgtgttgaatgtattttaggggaatttgttgagaattactagacctgaaattattggttataagtaatataaaaatatcactaggagaaacgctatgacgttatgtagcgtttctcctagtggtcaattaatccggaatatggcttccgttgggcatgggttgcagttatcgctacaatgttgataaaaggcagtatggaggcgtttgaatggcatacattacaaaaaagaagattgcacaagcctttcatgacgtcgtcctagtgaggggctttagccgaacttccgtgacggcaattatgagcaccgccgattttagacggcaaacattttatgattattttcaagataaatatgaattattaacctggtttattgatgacaccctgactgaaacggttgaacataatctgaattatttgccttggatcgacattattaaactagtttgttacgagttagatgcgaatcgtcaattttatgcagaatgtattaacacacagcatgaaattgacgtgacggcacttgtcggtaaccacttagccacgttattgactgaactaacgcacgccaatacaacagaaacgtcggccctaatctggttgctgtgcttgggaatcgcacaatcgttaacgcataatatcgttgcgaatcatcctgaagattatgaggtgctttctcagcacgctattgcggccatcgaaatgacactcgaaattttgaactagttaggccaagcagcagttttgacgggtcggtttagagcagttaaccagtcagggtcggctaggctgagtaaggttaatgacaacccatgcatcccgttagcagttaaaaaagttcccactttgttgaagtcgattgttagtgcggctaaggtgagtaattcgtgaacatcattattgaacaccatgagttccatgggcgttgtcccaccgagggagttaacgaaaacggcgtaatggtcgtcagcatgccacttaaagttgagacgtaatttactaattaattcctgtgcgagtcgttctgacgattgaaaaggttcacgccgataaccgggttccccgtgaataccgataccgtaataaatttcaccaggattcaagttaaacgatgccgttgactgtcctggaatgcgggcgccgctagcagcaaccccaatcgtgtgaatgtttggcactagggcggcagcgatgtgggtcaattcagcgatagaggccccctgagctgcagcggcaccaagaattttatgcactaaaatcgtgccagcaactcctcgtcggcgctgttttaaagattcatgatccacggaaatatcgtctgccacaatacatagaccagtttgccaatgttccttttgcagttgttgttgagcagccgtaaacgcactaacatctgctggaaaatttttaacaatgaaaaaaacgcgacgctggcgtgtcacctgttttgtgactttaacgatttcttgagatgtagggggttgaaaaaccgttcccatgattgcggcagttaacataccaggtccaacataaccccagtgtgccggatcgtgaccgctgcccccaccagcaattaacggaatctgatcatcttgaaagttgctgtcgtaacatccgaatgtatttggtacccatgttaaatttggataggcccattgaatgccctgagttgcttgactcagggcattttgaggttcattaatgatttgcatgggaacaccttcttatattgttaatttgattttattataacgcattcgaatgaccatgcttgtcagaagctggcggacaaaataacgaaactgtccattatttttgaaagcggattcatttacaattaacgtgttaattcgagaaaggaaggacaacaaaaatgaaaaaaataattaatgatcccaagaatgtcgtcgacgaaatggttgatgggttagtacgtgcctatcctcagtatttaactaaattaccggataccgaagcaatggttcgtagtgatcaagattcaatgcagggaaaagttggaattgttagtggtggcgggagtggtcatgagcccgcccacgccggctttgttggccctggcatgctcagcgctgccgtggcaggacaggttttcacctcaccgacgccagaccaaatttatgcggcaattaaggctgtcgatcaaggtaagggcgttttcttagtcgtgaagaattattctggtgatgtcatgaatttcgatatggcgaaagatatggctgaattagatgatattcaagttaaatcgattgtcgttgatgatgacattgctgttaaggatagtttatatactcagggtcgtcgcggggttgccggcactatctttatgcataagatacttggggcggccgcggatcaaggcgctgatttggatgatttagaaagtttagcaacgcatgttttaccacggattaaaaagattgcggtcgcattatccgcagcgacggtgccggaagtcggcaaacctggctttgaattggcagatgatgaaatcgagtttgtcgtcggaatccatagcgaaccaggttatcggcgcgaaaaaatcaagccatccaaacaacttgttcaggaattgctaggtaaattagatgatgaattacacctacagtcagatcatcagtatgcgttcttggttaatggtatgggagcgacgccattgatggatcagtatgtcttttgccatgacttgttggatgaactggcaacacggcacattcaaccggcctttatgaaggttggtaattatatgacttcgattgatatggccggtatttcactgacgatattcgatgttgctgaatctcaatggctagattacttacagtacccggtcaaaacaatcgcgtggtcataaggaggaattgagaatgttaacagttgagaacacaacagtatggctgaataagtttgctgatcagattgaacaacaccaaagttacctaagtgaattagatacgccgattggcgatggtgaccatgggggtaatatggctcggggcctagcagcagttaaggcagcacttgccacgcaaccagcagacataactaaactatttcaagcaacggcgatggcattgattagcaaagtcggtggtgcttctggaccattgtacggaacagctttcttagaaatggcaaagcaaagtaagattgatagcgatttaggtggattgttggccgctgcattagctgggattgaaaagcggggtggcgcgacaaccggcgataagacgctgattgatgtgtgggcgccggttgttcagacggtccaagcgggcgaattgacgcaggatgttatcgatgatgcagttgctagcaccgaaccgatggtggctaaaaaagggcgagcatcctatctaggtgaacgttcagtgggacaccttgatccaggtgctgtctcgagtggttatttatttacaacgttactggatacggagggaatcttatgagtttaggaattgtagttgtttcacacgtcccagaaattgccgcaggtattcagcgtttgttagggcaagttgcccaggacgtttcgattacgattgctggtggtacggatgacaatcaagtcggaaccagcctgaccaaaattacacaagcgtttgatgcaaatcatgcggatgaactcttggccttttatgatcttggtagtgccaaaatgaatctggaaatggccattgaaatgagtgataaaacggtccatttatatgatacggcactcattgagagtgcctacacggccgcatcgctattacaggcggctgtgccacttgcggatgtcgaagctcaattagcgccattaaaaatcaagtaggatggtgacgaaacatgcacggttttttaggtgaatttttaggtaccatggtgttaattgtatttggggttggtagtggtgccgccatgaatttaaagggtaattatgcacgccatcagaattggacgtttatttgcttggcgtggggcctagccgttacgtttggggtctatgttgccggacaatttggttcggatggtcatctaaatccagcggtgacagttggttttgcgttattcggttatttgcaaatggctaacgtttggccgtacttattaggccagttcttaggggcctttatcggcgcggtaatcgttattattcagtactacccacactttcaagctgccaaaacggcggcagatggcaatcaagttggcatttttgcaactggtccagccatcagtaacccggtatttaattttctaagcgaaacgattgcgaccttcttctttatcttcgtgttgttgaatctcggtaactttacccagggattaaagccattgatggtggggctgctcattgttgtcgttggtcagaccttgggtggaaccacaggctttgcgattaatccggcgcgtgattgggcaccacgattagcctacacgattctcccggttcctaataaagggttggctaattggggttatgcctgggttccaatgtttggtccattgcttggtggtattttggcagctggtctggaaacaattattagttaaatactcacaactgtgccgattttgttgggcacagttttttgttataaagtataattaaataaataatgcaagtttatgcaatcgcttgcaataacgatgaaaacgttttatatttaatgagatggattcaaatagatcggggggatcatgatggcaacgatcaaagatgttgcccagcgcgcaggtgtttcgccttcaacagcgtcacgtgcaatgcatggtagcaagattatcagtaagccaacacgtgacaaggtcattaaagcggcgcgggagttaaattacgcgccggattttaatgcacagaatttagcaactaaggctagtaatacaatcggggtggtactaccagtagatcatcacgaaatcttttctaacccatttttcttagagatgattcggggtatcaatgaagtttgtagtaagaatggcgcaatgacaacgctagcaacggggatttcaagtgatgaactggtgcataatattgatgtcatgattgcacaaggccatatcaaaacttttattttactgtattctgaaaaaaatgacccagttgttgagcgcttgaagcaatttgatgtccaatacgttgtgattggtaaaccttaccaagacgtcaataaaacatcgtatgttgataatgataatatccaagccggaacggatgcagcccaatatctaattgatcatggacaccggcgcattgggtttttgtattcggatttatcacggatggtgcaaagtgatcggatgcttggctatcaacgtgtaatgatgcaaaatcagttaccaaatattatgttggaagaacggtttgagactcatgcggcgggtgttaaaacactacataagttttttgaacagtatccagatgttaccgggtttgtggccgtagatgatatgttggcgttgaaattacaacaggttctccataatgatccgaactggaaagttaaacaattctcactgattggttttaataactccattttttctgatttagcgcacccgatgctgacatcgattgcggtctttccacagcgtttaggtgaagaagcggccaagattgcgatggctgaccatcctgctgatgaattatcaacggcagtaattgtgcctcatcaaattgttaaacgccattccgtccaccaaatcaagtccttacagtagtaagttaggggggtattttgattatgataacgctaaacgatgtcgcgaaaaaagctaatgtctcaaaaatgacagtttcacgagtcattaatcatccggaacaggttcgtcctgagcttcgagagatgattttaaatgtgatgacacagctagactatcatccgaatgcggcagcgcgagcgctagtagggcggagaacccgggttgtaaaattaacgatttttgaagacatggacacgacggaaccctattacatgatgttgctcgcggggattgcgaatgaattgaatcaacatcaatacgccttgcagattgcgacgcgcaatagctatgaggttggcgaatgtgatggctatattttgactggtattcggcaagccgattacgcatgggtcgaacgtcttaatcagccagtcgtctttgttggtagcaatcgtcagggatacgactacgttgatactaataattatcaggcggtctgggaaagtacacgttatgccgcggaacagggctatacgcatcttgtctttattggtatcgctattgccgaaccgtttgagctagatcgtgaacgaggttttcgagagtacgtcacgacacatcatattagcgctcagattattcgattagccaatcattcacacgttgcaactgcgtatgtgaagagccattggtctggttttccacgtaatacggcgtttatttgtgcaagtgatcggttggcgatcggcgttgaaacggcaattattaatcaaggtggtcgcgttcccatagaatatggcattatcggttttgatggcgtgttattaaatcagattgcagccaaacggttgacaacgatgaagcaaccgcttgaagcaatgggacgagctgctgcacggctattattggctaatatcaaccatactgatcgttctcgcgggcggcatgatcaagaaaaaatcatcattaattcacggttgtcggtggctgaatcgacccgttaaagaggagtctggataaatgagcaagcattggtatgatcaacaaacgatttatcaaatatatcctaagagttttaacgatagtaatcacgatggcattggtgatattccgggaattaccgcgaagattccctatttgaagcaacttgggattaccacgatatggttaaacccaatttatcaatcaccccaggttgataatggctacgatgtttcggattactaccaagttgattcgagcttagggaccatgacggacgttgagacgctcattaaaacggtccatgagcacggcatgtatcttatctttgactttgtcttgaatcatacttcagatcagcatccatggttcaagcaagctctcgctgatccacagagtaagtatcgggactactatttatggcaagatcccgcagccgatggtgggcgcccaaacaactggggctcatttttcggtggcagtgtttgggcgaaggatccggcaggcggctcacagtattatttccacttgtttgataaacggatgccggacctcaattggaagaatccggcagtgcaacaggcgatgcgtgatgttgctgagttttgggttgaaaaggggattgatggtctccggttagatgcgtttattcatctggctaaagcagattttcgccaaacttatccaaatcggactggtgattcgacacccatcattagcgatatgttttatgcccacttaccgaaagtgcatcagtacttacacgactttgtcgccgcaatcaaagctaagcacccggatacgtacgtcgtcggtgaagcgtcatccgctgacccccatttgatggtcgactatacgacactaggtacggatgagtgtgatcaagtgattacgttcagaacttttgcggacgacaatacccaggatgatccgagcttctccgacacatttcagccccgaccgatggatgtgacggcctataagcaaaatacggtcggtattcaagcggctttagcagacaccagtctaccaacactttactggaataatcatgatatggctcgggtcgccacgcgttacggtgatcctgattatccgcaagcaagtgccaaggcgttagcgacggccctgtatttgcagcgtggcattcccattatttattatggggaagaattaggattaacaaatatccgttatcatgatattgcggactttgaagaccagacggtacccacctttgttgcgagcgctcaagccgctggtaagtctaaggtggaaatcatgcggatgttgaatcaaactcataaaatggcggggcgcggccccatgcaatgggacaatacggtttatcatggtttctctgaccacttaccatggaaacatggtgatactgatgacatgaatgcgcaagcagaaatcgctgaccccgacagtatttatcactattatcaacagttgctgcagctaaagcagtgcgcaccctttactaatggtcagttcattatgctcggaagtgctgaacaactctttacctacctcattgatgatggtcaaaaacaagcagcgatagtttgtaatttaagtgcgcaagcgcaaacgtatctgttgccgtttgttggtggtaaagtgttgcttgtacagggtggtgcaacatataggggacgccaagtgacgttaccagcttggagtagcttagtcgttaaatcggcataagcaatgtgagtgcatgattatcctaaaattggtatatataaatcatgtgatgtattttaattaacttatcaatctttatataaattggtataaaggttgatggaccaataaatcctaacgtttttaagcgttaggatttatttttggtatgattctgttaacgttaacattacgaaaacgcttgcgaaagcgtttgcacagttgcataataaattatggtaaatgaattaagatacttcgcaaggaggaagcactatgagtacttggaaaaagttggggatgggtgtcctagccactggtttagcactcacgctcgtaggttgtggtaatagtaaatcttcatctagtagttcaaagatggacaagacgttaaaggtttcagcggatccttcatataagtcatacatgaaatcggtgattccaaagtttgaaaagaagtacaacgttaaggttaaggtttcatacaaggccatgcttgatgaagacgatgctttgaagctggatggtccttccggcaagggtcctgatgttttaatggcaccatacgaccgggttggtcaaatggcgtcacaaggtcaactatcaacagtcaagttgaccagtggtcgttacaacgcaacggggaagaaatctgttacttataagaataaggtttatgcagcgcctgtaacgatcgaatctgacgttctgtactacaacaagaagctaatcaagactgcacctaagaacttcaaggaacttgaaaagttagcttctgacaagaagtatgcttacgctaatgataagactaagtcagttgccttcttgactcaatggacaaacttctacaatgcctttggtgtcatcaaaggttatggtggttacgtctttgctgatggcaatacgaacgccaagaagatgggcttgaacaattctggcgccgttgaaggtttaacttacatgacgaagtggtttacgaagtactggccaagtgggatgcaaaatgtcacttctaacgaaaactttgtgacctcacaatttacgtctaataagactgctgctgttattgatggcccttggatggctgcaacttacaagaagtctaatatcgattatggtgttgctgttttacctaagttgaataacggcaaagattatcaagcgtttgccggtggtaaagcttgggcaatctcaaactactctaagcataagactgctgcacaagcttggttagacttcatctctaacaagactaaccaaaacaagctttacaagtctgctagtgaaattccagcaaacacagctgctcgtaaggaagctgtaagtactggcgatgacatggctacggccgtttcaaagcaatacgacaaggatgttcctttgatcaacttaccacaaatgtcagaagtttggacaccagcacaaacgatggttaccaatgctgctagcggcaagatgacaccaaagcaagctgctaataaagcgcaaaagacgatcttaactaatatctcacaaaagtatgataagtaattaaaattgtaatttaagggggctgaaacaaaattcgttttgtctcagcctttttaaaaggaaaaatgcacgatatttagaatttatttaggaaaggggtgcgggcgacatgcaagtcaaggatgtaaagaaagcgcaacgcctgtcaattattcccgggctcggtcagctgtataacggtcagaccataaaaggtgttggcttcattattattctattggcatttattgctgagttcatcttcgggggctttagcgcatttgccaatttagtcacattgggttcagtctcaatggaagacaactctttgttcatgatgatctatgggacgttgcagattctattgacaattgtgtttatcgtattttatattgcaaacctttacgatgcgaaacacgttgcacagttaattaataatggtaaaaaggtctcccatacgtttaaagagttaggtgcgagtttagtagatggtggctttgcttatttattaaccacaccggcctatattttaatggtttttacgattgtgttcccagtattggttacactactgatggcttttacgaactatgattttgcgcatattccaccagctatgttattggattggattgggttcaaaaacttcacatcaatgttcttcttgagtagttaccgggcaaccttcaacgctgtttttggttggaccgttatttggaccgtatgtgcaaccacgttacaaattattattgggattgccaccgcagtaattgctaaccaaaacttcatcaaaggtaagcgcttcttcggagtgatcttcttgcttccttgggcgattccagcgtttgtatcaattatgagtttttcaaacatttttaatgattcagctggtgcgatcaatgtgcaggtcatcggcttatggaatacgttagttccatttgctcacattgcgccgatccactggatgacggatacgttctggactaaagttgctattattatgattcaaggttggttaggattcccgtacatttacgttatgattactggtatcctgcaagcgattccagaagatctctacgaagccgcaacgctagatggtgcgacagtaatgcaaaagttcaacaagattacgttgccaacgatttttgctattgcagcgccaatctttgtgacgcagtatacgtttaacttcaataacttctcgatgatctatctgtttaaccaaggtggccctggtgatgtcggtgctaacgccggtgggacggatatcctgatctcatggatctacaagttaacaacggggacgtcaccacagtattcattggccgcggccgttacgttgattatttccgtcttagttatcgggatctcattgattgtcttcaagaagacccacgcgtttgaaatgggggactagtgttatggataatgcacaagcagtggcacctaagaatgccaattcaaagcaaaatagcgcgcgtcggcaccgtttctggaaagaattctttacgtatctgtatatggtcattctcggaattattattatttatcccgttttgatcacattcatcacggcgtttaaggatgctaacgtgcaagccttcgtccttgattttggtggtaagtggacgttggttaactttaagaacttatttacgcaaaccctgtatggtagctggtatttgaataccatgattatttcagtctcatgtatggtcattcaagtcatcgttgtgacgttagccggctatgtttatagtcgttaccgttttgctggtaaaaagttcagtctaacgtttttcatcgtaattcaaatggtaccaaccatggccgctttgactgcttactacgtcttagctaacatgttgaacgctttggaccattactggttcttgaccgcaatttacattggtggtgggatcccacagaacacttggctgatgaaaggttactttgacaatgttccgtatgatttggatgaatcagctaagttggatggtgctggtaatttcaagattttctggtcaattgtcttaccattagttaaaccaatgattgcggttcaagcgttatgggccttcatgtcaccagttcaagattacctgatggcgaagttcttattgacgtctgaatcacattatacggttgccgtagggctccagacattcattaataacgctcaaaatcaacaagttgtgctcttctcagcgggggcaatcttagtcgcgttaccaattgctgccttgttcttctacttacaacggttcttcgtttcaggattgctcgctggtggcagcaagggttaactcaaatattagtaggggtgaaattagatgcagagtacgaaaaacaaaacaaccgcctttccggtccggttttttggcagcctcttctcacctcgaagaatgtttgccaaccgtgatcagtttaattggttacagattattgttttatttatctttttgaccgcggtaatggtcatgccgattccgttttactataatcaccaaacgaattttaatctgtcaccatttttaccacacattgataaaatgatggccagtgatcagatgcaaacggcaatgaaaactgcgaactaccgtgatcagcggttcaaggatgtcaaacatcaaatcattattaaaactaaggataatgttgctggcttcgatctcacgaacgatgatatggcaggacgcaagaatgtcattaatttacatgctagtacgtttcaagtgaaatcggtcggtagtgaatttaaagccaagtatgtgccaggccataacttaaagacaaacgctcatgcgtttctggttaattcttggtatcaaagcaataaagtgatgattggtctatttatgctcatggcacttggattaattattgtgggggtcaacctgatcctcgtaaatggggcggcgttcttcttattcttgtcacgacataataagatcacgcatattcggaatttccgcgaaggcgttaacttaacgttgatgatgatggggattgggagtctgttagcgatggggattggcttaattcattttgatgtcaccatcgaattgaccgtgcagtccctcagcttggccttcgttgtgttgtgggtatatctgaaaacaaaattcaaagatccggaagttgaccaaaccatgttgctttaggtcaattagtaagcatagaaatgaggaagattaatggcacgcgatacgcaaacgcaattacgcaatgagatgatttactcagtctttgttagaaactactcagaagcttgtaattttgctggcgtaactgctgacttacaacgaattaaggatttaggaaccgatattttgtggctactgccaatcaatccgatcggtgaggtcaaccgtaaggggacacttggttcgccatatgcaatcaaggactaccgtgggatcaatccggaatacgggactttagctgactttaaagcactcacggatagggcgcatgaattaggaatgaaagtgatgttagacattgtctataatcacacttcgcctgattcagtcttagcaaccgaacatccagagtggttttatcacgacgcggatggtcagttgacgaataaggtcggcgactggagtgacgttaaagacttagactatggtcaccatgagttgtggcagtatcaaatcgacacactcttgtattggagccagtttgtggacggttaccgttgtgatgttgcgccattagtgccacttgatttctggcttgaagcgcggaaacaggttaatgcgaagtacccggaaacgttatggttagcggagtcagccggcagtggttttattgaggaactgcggtcacaaggctacacgggtctgtctgacagtgaactttatcaagcttttgatgtgacatacgattacgacgtcttcggtgattttaaagattactggcaaggacgcagtacggtcgaacggtatgttgacttgttacaacgccaagatgccactttccctggtaattatgtcaagatgcgcttcttggaaaatcatgataatgcacgcatgatgagcttgatgcacagcaaagctgaagccgttaataacttgacctggatcttcatgcaacgtggtattccgttaatctataacgggcaagaatttttggccgaacaccaaccatcattgttcgatcgggacaccatggttgcagatcgtcatggggacgtgacatcactgattcaaaagctagtgactattaagcaactaccattactgcgtgctgcggactaccaattggcagtcgtagaagaaggtatcgttaagattacttaccgtgcggctggcgaagcgttaacagcctggattccgttaaaaggtcaggtcacagcagttgcgactaagctagcagctggtagctatcaaaatctgttaacagatggtcctactgaagttgtggatggcaagctgacagttgatggtcaaccagtattaattaaatatgccactaatacggcggtaactaaagttgctgaccagtccaattagctgattaatagctttgagtaatcgatcaaaaagcaaccgtttgcgggcgattgcacgtgtaatagtagtttagaagtgagaaaacaagggagtggatttcgatggttgaaatgaatctcgatcacatttacaaaaaatatgagggtaacgataaatattcagttaccgatatgaatcttgatattaaagatggggagttcatcttcttcattggcccatctggctgtggtaagtcaacgacattacggatgattgctggcttggaagacatcactaagggtgacttcaagatgaacggtcaagtcatgaatgacgtggaaccaaaaaatcgtgatatcgcgatggttttccaaacttatgcactatacccgaacatgtcagtctttgacaatatggcctttggattgaagattcggaaaacttacagtaatactgaaatcaaaaagcgagtggataacgctgctgagcaattgggcttaaccgattatctacaacggaaaccagccaatttatctggtggtcaacggcaacgggttgctttaggacgggccatcgtccgggacgcggggacgttcctattggacgaaccgttatctaacttggatgctaagctacgggtcgatatgcggactacgattgctcaaatgcatcaacgcttgaagaccaacatgatctatgtcacccatgatcaaattgaagcgatgacgatggctgatcggatcgtcattatgaatgacggtaagatcatgcaagttgggacaccgcacgaattgtataacgaaccggttaatcaatttgtggctggcttcatgggatcaccttcaatgaacttcttcaatgccaccttacatgatggtcgggtaactgatggtgagggactcgacgtagctgtcccggaaggtcaattgaaagttttaaaggctcaaggctatgaccagaaaaagatgattgtgggtatccgaccagaggacattcatgctgagcaaattgcgcttgaagcgatgtcagattcaattgttaagacgaaggtcgtcgtttctgaattcttaggtgccgaaagcatgttatattgtacagctggcaaatctaaatttactgcccaagtggatgcacgtgattatcataacccgggtgagaatgtggaagttgcttttgaaatgtcgaaggcccacttctttgattctgaaactaaagatgttattcggtaatttcgaacgacggaggagcaacaacaatgaaacgtatttttgaagtagatccgtggcacgtcattagtcatgaactcgtaccgacggataagcgattgcaggaaagcatgaccagtattggtaacggctacatgggtatgcggggaatgtttgaagagcactattctaacgataccctcaaagggatttatatcggtggggtctggtatcccgataaaacccgggtcggctggtggaagaacggttatcccgattatttcggtaaggtgatcaattcggtcaatttcatcaaagtcaatatcacgattgatggtgatcaagttgatttggcgaaggacacagtcagtgactttacgttggatcttgatatgcatacgggaattttacggcgttcatttattattaccaagggtgaaaagcgcgtccaattcatgattgatcggttcgtcagcgttgcacaaaaagagttatttgatgtgcactatagtgttcacaatttgggtgcggaaccggtccaaattggatttatttcgcaaattgatgcggacgtcttcaatgaagatgcgaactatgatgagcagttctggcaagtgctagacaagagtcatgcgattactggtggcagcatgtttgcagaaacgaagccgaataacttcggaacaccgcgctttacgctcggcatgcagatgcttcatgaaacggcttttcgaggtattaacgccccagaaaccgaaaaggcagttacaaatatcttccggggaacgttagcaccggatgaaaccaagaattttgaaaaacgagtcctcgtggtgacttcacgggattacgcggatatggcggcgatgcggactggcttagccgaattaagtgaaacggtcagcacacagtcatatgaggacttacggcaggcccatgttgatggttgggctaaacgctggcagttatctgacgtgttgattgacggtgacgatgcggcacaacaaggcattcgcttcaacttattccagttattctcgacctactatggcgaagataagcgcctgaacctggggccaaaaggctttactggtgaaaagtatggtggtgcgacgtattgggataccgaagcgttcggagtaccgttctacctttcattggcgaaaccagaagtaacggagaacttactggaataccggtataatcagcttgctggagctttccataatgctaaaatgcagggcttggctggtgccttgtacccgatggtgaccttcaacggaattgagtgccataacgaatgggagattacgttcgaagagattcatcgaaatgggtctattgcgtatgccatcttcaattacacacgttataccggtgatgagatctacttgaagactaaaggaatcgacgttttgacggggatttcacgtttttgggctgatcgggtccacttctcagaacggaaacaacagtatatgattcacggtgtcactggtcctaatgagtatgaaaacaacgtgaatgacaattggtatacgaactttatggcgcgctggacgttagaatacacgttagcgagtttgaagaaagtggatgccgctaagcgtgcagcacttcaaatcacggatgctgagcttgcaaagtggcaagatattgttgaccggatgtacttcccgtatgatgaaaaattgggaatcttcgttcaacaagatggcttccttgataaggacgtcaagccagtttcaagtattcctgctgatcaacggccaatcaatcaacactggtcatgggatcatattctacggtcaccgtatatcaagcaggcggatgtcttgcaaggaatctattacttcatggataaattcacggcggaacagaagaaacgtaactttgatttctatgaaccgttgaccgtccatgaatccagtctttcaccagccgtccatgccattctagcagcggacttgcattatgaggataaggccgtggaaatgtatgaacggacagcccgtcttgatcttgataattataataatgatacggtcgacggcttgcatattacgtcgatgaccggttcatggctcgcaatcgttcaaggctttgctggtatgcgagttaaggatgataccttagcctttgcaccgtttgtgcctaaagcgtggacccattatcaattccacgttaacttccgcggtcgcttgattaaagtggatgtcgatcaacagggtacgaccgttgaactggttagtggggaaccactgactatcgaacttaatgggcaagctatcgaggtcgctagcaccgtaacaactaagtaaatatgaacgcttgattgtggtctgaccgtacctggccacaatcaagtttccaacctaagaatgagctcaattcattccaacctaacttctaaatcggtccgtatcagctgatacgggcctttttagtgtctggacataaaagagtccctcacttggaaatatcgatttccaagtgaggggctcggctgttctattcaaatagcatcggtagggttatttgagtgtttgcgtcaatcctagcacgtccatttcgtaaatccgaacggcggtgtcagcaacttgggttggtttatcgacgactaaccggacgtagcgcgccgaagtagccgcgaaagtattgagactagtggcttgcgtgttattgtaggtccgggcaacgtccgtgtagcgtttgccatcagtgctgacctgaatggtccaagcgcgggtgttcatatcagcaccttcgccaccagctttggcatgcgctaatttaaccgcactcacagtcgtttgacggcctaaatccagcgtcaaggtatgcggtgccttaccggttgcacaccatttagtatcgagtttcccatccaccgccattttaggtgcttcactactattcgtgtatccggaggcactggtcttggcgttcttggatagtaaggttaaagcgccttgagctttcggtgtaatcgtaatgagctttttcattgtaacgtgccgttggccatccttatttttagcggttaatgtgacgttataagtgccagccttacggtaagtgaccgtggggtttttggcggtgctggtcgtctttgtggcaccgtcaaattcccatttatagctggttgcgtttttggatgaggcatttgtaaacttgatcgtgttaccgggagctgccagggtgcggttaaccgtaaatgccgctttaggtttacgattatccggccattttaaggtaacttggtcagaagcatcgccacgttggttccaaatatcaactggaacgaccatcagattggtctcgttgtgctgcccattccgtttcaacgcgtttaaatagaaattagtcgtgttagtggcccccagaaatgagcgagaaccgtcattgttaacctgataaatttcgtaatgatccagcttatttttagtggtggcttgccaactcaggttgacaccggcgtacttgccttcttcgtcgaaggtccgattatcaatggtgacctggttgacctttttcggcgcggcctgctgcttgccggtaattgcgaggcgacctaattgaacgctgtagctagcatcagtctcggcggcactgattttgaggctaaggcctttgattgttttttttgttaactgactaacgtcatagctaacggtcgtccagtgcctgctgagtgtccggtcacccgcgatggtcttagtgcggccgtcctttaaggtcaccactagtttagctgtagatttaccagatgccttagcggttaaactaacctgggtatcggcagtgacgtctaggtccgtggtgtagagtttgattgtgctagcggtgtccttacgcattttgccggctaacttgatatcattgccaccttcgtaggcgtcagtgtagtcaaagctggcctttaacgcattaccattgccattattgattaaccagcggtaagtcggattgactgcttgcagtgagcgattgttccaatcacgtagcgaaacatttttccccttaatgaagtagttatagccattgcctaagctgaaattagtgacaaagggctgtttcgtaatggcactttgttcaaccgcgtatgttgaaacacccggccaatgtgttgaagtagttgacggaatgctacgggacggatcattttgatcattgacccacagagcaccttctttggcttgaaattcgtcaaccgtatcggaagaagcgtgtgtccagtccggtgcgtacaatcctagcgacgtgtatggcacatgttgtttattagcgaatagattccaacgaacgggggtagcggttccgtcagcttgaacatcgattcctgcaaagaggttgtaaggactaatcccaagcttttcggcgcgttcgtgtgactttttgagtaattcttgactggcgagacgcttcttcgtccaccagaagttaagaaacatcgagtcagcaactggtttcatattggcatcgactagataagattggttttctttggtcaatgcgttttgccaatccattttaccatccttcgtcatcgagtcataccacatcaggtctagcttggagccggccttttgtttgtattctttgattaactgttgcattagttgggcgtgctttttgctcagcccattactagttgagctggttgcggtctttccggtggaagccgaatcaaaacttttaacttcggggtcggtctcttggttgatgaaccagccgtcaaacccgtaagctttcgcaaccgcgactagtttatcagccatcggagaatgtccgtcagcatcttgttttaagaagtcattgagccactttaacttcccaccactaaccacttgtggaaagaaaacggttccaagaacgggcacgccgtttttatgagcagaatcgatgacatctgcggtcggtggcacaatcaaaccttcgcctgccgaaccgccccagtagacgagttggtcaatatactgccagttggagaagacattcgcatcgaacgtattaatcccgcgaggcgcgttgccactagttgaactattcataatggataacgcgacgaccttcatctttgggtcctgggtcttgttaaccgtcggcagttgccatttatcgatccgtttggctagtggaaccgaggcggtgttgtacttggctgctttatccttgctcaactgccatttcagcagttgttttggaaaccagtacggtgctacgggttgattatccatccccttatcaagggtggcctcagccgtttgacggtaactgatctgctgattagctgactgtttcgaacaagctactaaacctacagcagtcgttatcaaagctagtgtgccaacaatgtagcgatattgtccatgtctcatagcgatatcctcctgtgaactaagcaaaattgacatatccgcgttatgtgagcgatgattgcatgaatcgtaattaaaacgtggcctcgacttagatttttgactaccgcgctctggcaattggcagaaatgcctggaggtcggtgtagggtgaactaagcatgtttacgctaacccgaactctttccagcgagcctaagctgactgcttttgacgttaattattttgcctactttaatcatgactcatgacaaattagctagcacaacgcgtaaaatacaaaaatctatatattactggtatgtatgatatcggtttcagtgacagatgagtatagctaaattaagggaattcttccacaaattaaactaattgatagggtcaatcaattttgatgtaaggggaatgctgggtttcaacttgcgcgcaacgtgcgaatagttgaggattgttgcggtgccgatacaatttaacgaacgcgaatttttgcgtgatgagtggtatgtagtataataactagctaggaaggtgattatttattaggtagattgcaaatttaatcnnnnnnnnnnttaattttacaatctaccattaagtataaagttgataatggtgaatatcccagtggtaaggacgctgtggatcccaagcgagttaaatatctgaaattgattagtaagttagcgacatttacgtgtattgcgatgtacgtgtcgtatattccacaaatcatttcgaatttctcaggtgacccagtatcgccgctacaaccactcgtggcaatgattaatgggatactatggactggttacggctggttcaagacttataaggattggcccgttattatttcaaatgttcccggggtggtttttggatttatcactgttttaaccgtatatattcattaaccgaatgacaaattgactgtaaactaaaagtccgctgatacgtttaaacgcgtatcggcggacttttttgcaaggtgttaagcgttctttaaagcagcctgagctaacaataggccaccggcaatgccagaattgttacccagtccagcgggaacgatatagtcatccagtggtgggacttcttcgtagccatttagataggcggcaaacttttcacgaatcatgggaaagagctgccgttgattcataacaccaccgttaagaataattttatcaggtgcgaaggcgacggtgaggttgacacatgcctgtgcgatgtagtcagcgatgattggccagaccggatcgtcgacgggaatatctttcccagctttccccgttcgttttccaactgctggcccagcagctaaaccttctaaacagatgtcatggtaggggcagttggacttgaaatcgtccccaggtaaccggttgagtcgcatgtgaccaagctcagtatgagtgcgaccattaaaaatgtggttctgactaatgacgccagcgccaacaccggtaccaatcgtcatgtagatgctgttagggacgtccttagcgattccaatcattgattcgccataagcggcttcgttaacatcagtggtccagtagagtgggatgttgaagcgacttttaagatggcctaaaaaatcgaagtcaccccagccgggtttgggagtcgtggtaatgtaaccatatttcggatcatcgggattaacgccgatggggccaaatgaaccgataccaatcgcgtcaacgggatgagtcgtaaaatagtcgtctaccgcagtcatggtttcagcgggggttgtcgtggggatcgaaattcggtcgctaacttgcccgttttcagcgcccgtggcacaaacaaattttgtaccaccagcttcaattgcacctaaaagcatagtgtgcctcctgtagttaaaaatgtagtcctatttattaatagtatactcttaatcagaaattttgttaacgattacattaactttgacgtaaataaattagctgactagtgaaatcagcgttggtgggtttaagtggaattcccatcgtgtttaactgatgccccgtatagctattacctgatgaatcgctataagttaattcagcatcgagatagtgtaatggtaatgggtgctgatatttaatcaaggctcctcgaagaagttgctgttcactaggagcaagttgtttaggattaagttccaatcctagttgcccgatgcaggctaattgtaatcgagtttcaaatggtgttattcggccattttgcgcattgggtgatgcggttatatggttgctgaatatccgtggtggaaatagataactaaatccgttctcgatggttgctcggtcgactggatcagtcaaatcgcttatccacgtctgattggtgtatggtagcataccaaaatcaaaccggccaccaccagctgaacaattttcgataatcagcttggggcaggcgcgcttcaagcgtgtgagaatatcataaagtccacagacgtagcgataatacagttccccctgttgtgcagccggtaagcgtgtgctgccaacctgtgtaagatggcgattcatatcccatttaaaataatcgagttggttattttgaaccaagttcgtcagagtagtgactaagtggtcacggacagcagcctgcgaaagatctaagactagctggtggcgagctgtgatgggtgtccgatcaacatattgtaatacccagtcaggatgttgttggtaaagctggctgttagtggtgatcatttctggttccacccagagaccgaatttcattcgatgatgatgggcttgttgggcaaggggtttcagaccattaggaaacttaatggggtcaacataccagtcacctaattgcccattttcaccgttacggttgacaaaccagccgtcgtctaagacaagcatttgtaagcctaactggtgggcgtgttcgattaagtgttgaactttagactctgaaacggcaaatgtcagtgtttcccaagtgttaagcacacttggaatgttagtctgggagggcatcagctgatggctaaagtcgtgaaatacttgtgacatgccgttaaaaccagtatttgtccaagttagcacggcttcaggagtctgaaaactgctatttggtttgagctgccattcgaatgtatctggttcaagaccgattgttaggcggctatgttgatattggtcaacttcgacagtactgtcgaagttaccactccatgctagtgcacaaccaataacagtcccagctaattctgtcgtgttaggttctgctagagccatgaacggttggtgttgtggtccactagtgccgcgcagactgcgaaccgtttgtaaccctgggtgtaaacggttaaacgatggattagcttcatgtgcatgggtaccgcttaatgtcagcgcagtatattggtcagttggtagatctagttgagcgctggatagggctgttacttgcaaattagtagtgccgtgatggcgcagagttgtgcttcgcaagataagcggctgattttcaaaaatagtgtagttaagatccatctgtaacttggtcactgaatcggccaaatgaatgactagggttgttacaggcgtgtgtttgctaacggtgggtggcaattggcgcgagttgattggctgatcattcacagaaaaaccggtatattctaaaattggcagtaattgattgttagcatccttaataacgtaagctggctggcgatagtcaccactgccaatagtggaatattcgagtggcagtgaagtcacggaatatggaaagcgttctgttgggtcattagcaaaagcatggctaccggatggcatcggctcaaagtacggttgttttgaaaagtaacgtccaaaatatcgatgcactgggtaacgatgggctaaaatttgaataacatagctaatttggtcattatgaagattgattaagccggttttggggtcatattcaacaggcatgacgtcctcctaataaagtttagacagttgtagcagcaactgagctagctgccggttcagtcagcgcaacgagctgttcactagcttggacattcgtgactttgagtcgttcaacattagcgtaattggccgtatttgtgacgactagcatgacggttggatcatagttagcggcttttaaggcagcgacgtcaaacgttccgagtagatcaccttgatgaacggtatcgcccttctgaacgttagtagtgaagtgttcaccatttaaattgaccgtatctaatcctaagtgaatcagaatttcggcaccagcagttgttttgatgccataagcatgatggctatcataagtgacagtgatgaccccgtcagctggtgcgacgacctgatcagcgcttggcacgattgcggcgcctttacccatgatttcggctgagaaaacttggtcgttaacttgtttgagactttcgctagtccccgttactggtgcactgataatctcatcattaacattgatgacggtactcgttggtgctggtgattttacttgatcacgatcgtcaccgagtgttcgtttggcatagataaaagttggaataaatgcgacgacgaacgagatgacagcactgagcatgaatgctggaatcgactttgaagcaatcgaaatgaacccgatgactgatgcgggacccatcgccacagacagaacgtggaatagtcctaagaaagctgaagcaattcctgaggcaatcgctgcaaagacaaatggaaatttcatcttgaggttgaccccaaaaatagcaggttccgtaattccgagtaacgctgagaccccggctgaagaagtcagggctttttgcttttggctcttagtggcaaagaaaatagctaaagtggcggcaccttgcccaatgttggccatcgaggcgactgggaagataaaagaacctcccgttttggcgacgttagccaataactgggtttcaatagccgggaaggtttggtggagcccagtaatgacaatggccgagtagagaaggccaaagatgcccatgccaatccaaccagtcgtgttatataagcctactaaaccgttagttaatgcgtcgctcaccgttcgtaagacaggaccgacgattgtgaaagttaggaagccagtgatgacaattgcaaacattggcgtgaacgtaaagtcaaatgcacccttgatatgtttgtggaagaacttctccagagtagccaaaatataagcaacggccaaaacagggagcacttggccttgatagcctgcttgtgcaacgtgtaaaccaaagacgttccagtaaaccatcttgccggcggccatggtcgttgcaacgctatagccgttaacaagtgatggtaagaccatgatcatgcccatcgtagcacccagataggggttgccgccgaagcgcttcgttgctgaaaatcctaagagaattggcaagaaagtgaacggggcactagccatcgcgttaatcatttcggcgatacctttgagaccggggtaaacttcaacaactgacttcgccataaaaagatgctcggcagtcaaaacgttgtttagtgccattaatagacccccagcaactagtgcagggacgattggaataaaaatatcagataagactttgaggaagtccattaatggatttttcttttgacccgcagcggcaactgccttgatgtcatcgggggtcgcttctttaagacctgttttggcgattaaggcgtcatagactttatcgacatcgccagggccaataatgatttgatattggccgttagtttcgaaggtccccttaacgtccgcgtcgtcatctaaggcttgttgatcaatcttggattcatccttgatgaccaaacgaaggcgtgtcgcacagtgggcggcggcttgaatgttgtttttaccaattgcattaagtacgcggtcggcaacttcttgatgattcataataattcactccctgagtctaaaattatttttaatttaataatgcaagcgctttacagacccaataataacaagtttggaaaatatgtcaagcgtttgatacaaaattgaattgcttgataatcttgctaaaaagccgaatttgaaacgctgacatgaaaatataatataaaaatgtcaaacgattgacatatcggtgtaagcggttttataatagtgacaattaagtcgaacgttaaaaaggagctcatcgtcatgatatggaatcgtaaaacccgttataccccttatgaacagtggccagcaactaagctaccacagctcgttgcccaggcacgccagtctaagtggcggatgcaacatcatattcagcctacatcaggtttgttaaatgaccccaatggcttttcatactttgatggtcagtggcacctgttctaccaagtctttccgttcggtccggtacacggactgaagtcatggcaacacgtgacctctaagaacttggtggattggcatgatgagggcttagcgattcgaccagatacgccgtacgactcacacggcgcgtacacgggtacagcactaccaattgatgatcagttatttattatgtatacgggtaatgtccgtactgccgactggcaacgtgaatcgtatcaattaggtgcctggatggacacggataatcacattaaaaagctgtcccggccactaattgcgcatgctccggctgggtacacgagttcgtttcgtgatccggacttgatccggactgaccacggctactacgcgctgatcggtgcgcagacgactactgagatcggtgctatcttggtttatttctcaaaggatctgaccacctggacgtgtcaaggcgagttgaacgttcccgcaaatgcgcggggttatatgattgagtgtccaaatctggtctggatcgatcaacagcccgtcttattgttctgtccccaagggttatcacaaacaacgaccccgtatcagaatatttatccgaacatgtacctagttgccgatcaattggatctggctcaggcacaattcactgaaccccacgccctgacgcaattagatgatggctttgacgtgtatgccacgcaggcaatcaatgcgccggatggccgcgcgttagccgtcagctggattgggttacctgaaattgcctatccaactgatcgtgaaaattgggcccattgtttgagcttagttaaggaactaacgcttaaagatgggcacctctatcaaaatccagtggcagcggtggatgatttgcggatgacggcgcatgacctagtctttgagcaacaacgggcgacggtggccgctttgaatggcagctttgaactcttactgacggttcccgctgataaaacggtcacggttaacattgctgatcagcaggaaagtggccagctgcaggtgactgttgatgccaaccatggtcaggttatgattgatcggcggcatacggggaattcgtttgctgaagattatggtcagactcgtcaagttgagttaacggcccataagacgataaaaatccggctaatcatagatgtgtcagtctttgaatgctatattgataatggctattccgtaatgaccggccgtttcttcttaaacgctaccccgagtcgccttaacgttcaaggtgacactacggcagtcaccggtaaagtctgggaatggcgccaatcagagcatactggagtcgataacaatgaaaccaaaattaaatgatgttgcgaagctagcgggggtctcagcgacaaccgtttctcgggttattaataaccatggctacctgagtagtcagactaaagaaaaagttttcgcggcgatgcgagaactgcattatcagccgaataatatggcacgctcactgcaaggaaagaatacgcgcttaattggcgtcatcttttcagatattagtaatccgttctttggtgaactggtgtcccggattgaaaaaatcttatttgctaaaaattataaggtgattttatgtaatagtgcggatgatccgcaaaaagaacgcgactacttacaaatgttgatggctaatcaggtcgatgggattattgctggtgcccacaatttaggtattgaagaatatcaacaatacggccttccgattatttcatttgaccggtacttatccgacaatattcccatcgttagttcggataattaccaggggggctggctagcaacccagacattgcatcaggcgggggcgactaacgtggctatttttactggtaagtcacacgctggttcgccaacgaatggtcgccgtgaaggatatgaagcctacttgactgcccaacagctaacaccccatgtccacgaattaccgtttgaattgacccccgcgctgaagatgatggaaattaagacgattatgacacaacatcagtatgatggtattttttgtagtgatgatttgaccgctttactagtgctcaacgtcgcgcgacaactgtcattaacggttcctgagcaattacgcgttgttggttatgatggcacggcgctcatacgtgattatcattctgaattaacaacagtagaacaaccgttagcggatattagcacgttactggtttctctactattgcagcggattgaggatgcgaattgtacactggaatcaaaatatacgttaccagttaagctcatcaagggccttaccgcgtaactaaggagttaatcgtaattatggcagcaacaatcaagtggtggcaacaagccgttgtctatcaggtctatccacggagttttcaagataccaatcatgatggtattggtgacttaaaggggatcacggcccacctagactacttaaagcaattaggaatcgacgtcatttggctcaatcccatttatcgttcacccaacgatgataatggttatgatattagtgattatcaacaaattgcggccgactttggcactatggctgattttgatgaattattgcaagccgcccatgaccggggcttaaagatcatcatggacttggttgttaaccatacctctgatgagcatccatggttcaaacgcagtcgccaggaccgcaccaatcaatatcgtgatttctacttttggcgctcaggtaacggcaaaaaggcgcccaataattgggatgcggcttttggtggttcagcatggcaatatgatgagcagacccagcagtattatttacacacgttttcaacaaaacaacctgatttaaactgggagaatccgaccttacgagagtcagtttatacgatgatgacctggtggctgaacaagggtgttgacggttttcgaatggacgtcattaaccaaatctctaagttacccgggttaccaaatggtccactgaaaccgcacagtcagtttggcgatgctcgagtaacgaacggaccgcgagttcatgaattcttgcaagaaatgaaccaagaagtgttgtcacagtttgatatcatgacggttggtgagacccacggggtgacaccagcggatgcgctgaagtatgcgggcgctgatcggcacgaattagatatggtctttgaatttcaacatctgcgacttgataatagtcagcatggtcttggtaagtggagtacgcgtaagacaccgttagtggcgctaaagaaagtcattagtgactggcaagtcggacttgaagggcgggcttggaacagcctgttttggaacaatcatgatacgccacgagcggtctcacgttttggtgatgaccgaccagcatatcgggtacgttcggctgaaatgctcgcaacgtgtttacacctcttgcagggaaccccgtatatttatcaaggtgaagaactggggatgactgacgctcattttactgaattaaccagttaccgagatattgaatcgctcaatgcctatcgtgatttagtgactgagcgccaactactatcaccggcagatatgatggcccgattagcggcgcgttctcgggacaactcgcgaacgccgatgcaatgggacacggaggttaacgcgggttttagtgacgcggcgccatggctcacggtcaatcccaactatcgtcaaatcaatgctgccgcagctttggctgatctggattcagtgtggtactattaccagcacttgattcaattacgacatcaataccccttagtgacgttaggttcgtttgagctcttgtgggccgatgatccgcaggtattcttatatgaacggcaatgggaagggcggacctggctagtttgttgcaatttcacagccgagacactgtcccgaccactggatcaatatctgacgcccacggccaaatgcttgattagtaattatggcgagcagcagccaaataaattacggccttatgaggcttgggtctaccgactcgcataggtatccgggacttggctaattgaggcggtctttgaaatatacccaatcgttacgattagtgtgaattgggttgctcaaaattctgcgatggtcttaataagcgaccacctgactaaaaaactgctttcaaaagttatccttttgaaagcagtttttttagcgcgcgacgaccacttgacccacgtgaggctcatctagtcgttggtgaccttgaatgaagcccgtgaggttaaacggtagttgttcattgatcgtcgtggtcaattgaccagtatctagcaacttgaatagcaattgtaaggcggcctgatcagaaatcacttcggtcggttggattgcttggaaacgaattgatttactggtggctggcaagtgacgggcaaatgaagcgatggtcgcatcaaatttggccattgctaagtcatctttgccaccaacgccatcgatagcgacattgattacgacgtcaccgcggtcggctaacacgtgaactggattttgatgctgatagtcgacgaattggtcgactcccagtgtcgcaatcaatttagcataacggtcactagcaatcgcgataacgtgggcacctaatcgtttggctaactgaataattaacaagccgactgggctgccagcgcctttgacaatcaccgtttggtcggcctggatgtccgcaaagtagcgcaccgttttgtaagcgacaatccctggagtgactaagctgacggcggtgaccggatcaagattagttggcatggtcaccgctagatcactatctaaacaaacctggtccgcgtaagtatggttcgtgcgggcagccaccactgtcccaacgtccaagtcagtgacagcggcgccaacttgaatgattttcccaatgacatcatgcccaggaatatgcggtagtgtgacgctttggatagtacctagccgttctaagcggtcttcctcggttaggttaacggctaaagttttgattaataattgattatctgttggaatcagctgtgattgtggtagttcttcaaatacggtaggtcccccaaatttttgatacccgtatgcaagcattgtaatccccctcctcatatctaagttcgttagttgacgtggtgccgggatgtgacttattagtaaataaatcatgcagtatcaattgacgaattgttagattgatccaaaacatgctcttgtctaattgtagccagcagtgggggcgaatcacaagcagtaacaattatattccgggattggttcggtcaccgattaaattaaacaacctagttttaaattaaccggcttcgttggctggctgatgcttcaggccccagccagtgaaaccactgataattgagaataccggtgatagtaagctgaagaaacaaaatggcaggtaagctaaggttgataccccgagcgtgttagcggcaaaggccccggcaacgccccacggaatcaggtaattgatgacagttccaccgtcttcaaggactcgactgagggctaagttagccaatcctcgctgattgaaggtcgttttgaacgctttaccaggcaagataacggaaaggtactgttcaccgacaaagatgttgacaccgattcccgctaaaatcgcagccgtaacagttgccccggcacctttcaatcgcttagttagcggcaccattgctgtctgaatgaggttgaatttcattagtaaaccgcctaacgacagggttaataggattaaggagaccgtgctcatcatggcactgataccgccacgtgagagtaaggcgtccaccccggcgttgccagttttggctacaaagccggtttcgatcatcgtggcgatcttagttaaggcaatatgaggttgctcgataaaaatcatgacgatggcaagaccgatattcatcaacaaggttgcaatggctggaattttaagtagggcacaggcaaacatgacgacgagtggcaaggccgcccaccagctgatggtaaagttattattgaggacggtcaacgtcgtttgaatcttgcccaaatggctttgtgttgcggctccggcacctaaaacggcgtagagtactagtgatacgacaaaagcaggaatcgtagaccacatcagattacgaatgtggtcgaataaatctgcttcggcaatggctgcggccaggttggtcgaatctgacaacggtgaagtcttatctccaaaaatggctcctgagatgatagctccggcaatcaaagctgggttgatgcccatcgttgtcccgattccaaagagggcaatcccaatcgttgagataatcgtgaaggcactcccgatggaagttccaataattgcacaaacgagaaaaacggatggaacgaaccactgcgcagagatcagatgaaacccaaagaccatcattgaaggaatgatgccagctgcaatccaaacgctgatgagtgccccgatgagtagaaaaataaaaattgggataatcccagttttaataccatcgatgatgccaccgtgaatgtcatcccagtgggcaccgcgaattcgggcccataaaatgatgagggcgataacgagaataacgggggtctgtggtgacaggccgaacttaataacgccaagtcccataattgcaagcataatgagtaaaacgagtagggcttctggtaactgaactgaacgccatttctttgaattaggcataataattaactcctttgaggtcgttaaaccagcagtgaatagcccgacacggactgcttcaacagcggttgtacgccgataatagtgggtgaatataaaaaatcgtccctgttgcataataatgcaacagggacgattgattagaccgtggtaccacccagcttgagccacaatatgaccccactcactagcagttaacggctctagttgttatccgccgggcgtacccggacctctcctaccgtatttcatcgagattaacctgatcggttcgcagcacccaccgacttcctgacgcacagttaattcgctacttgaaagtaagattatcgttcgttatttgaatataagcgataatagcatggcgtttttgattcgtcaactaagatatggctagaaacgtgttaggctaacaaataaatagcgataagtgggtacgctcaaatgaccgacaatggtagaatggttagtgttgtaagcggtgccttttatggttgaccgtgacaagttttttaaagcaaacttttttagggggataatcatatatggctaatcaatggtggcaatcagcggttgtttatcaggtttatccacggtcgtttcaggattcaaatggtgatggaatcggtgatttgccaggaattacacaacggttagattatattaaacagctcggcgcggatgtgatttggctcaacccaatttaccgttcacccggtgtcgataatggctatgatattagtgattattacgatattaatccagaattcgggacgatggctgattttgatcaattattaacaacggcccatgcgaaagggttaaaaatcatgatggacattgttgtcaaccattcatctgatcaaaataagtggtttacgacgagtgcgcaaagtaaggataatccgtacgcggactattatatttggcgtgatcctgttgatgggcatgaaccaaacaactggggtggctttttcggtggctctgcttggaaatatgttgccagccgtgatcagtattacttacattcatttgcggttgaacagccagatttgaactgggataatccgcaactacggcaagcagtctatgacatgatgaatttctgggtcaataagggcgtggacggtttccgcttggatgtcattaacttgatttccaagcctgatagctttgcagatgggcagccagaagctggggaaccatacgcggcaatcggtggaattattgccaatggtccgcatctccatgaatacttacaagaaatgaatcagcaagtgtttgcaggccatcaactgatgacggtcggcgaaacgcctggggctacggttgctgatgctaagcaactggcaagcagccaaggtcaggaattaaacatggtgtttgaatttgaacacatgggcctggatggtaatccagatccggcgctaggtaagtggaatgaccagcccgtccgactggttgacctaaagcagagcttgtctaagtggcaaatgggcttacaagggacagcctggaatagtctctattggaataatcatgaccaaccgcgaattgtgtcacgattcggggatgaacggccagcttatcgggaacgttcagccaaaatgctagcgaccctattgcactttcttcaagggacaccctacatctacgaaggtgaggagctaggcatgacgaatgcccattttaccaagttaaccgactatcaagacttggaatcactgaatgcgtatcatcactttgttgatgacgaacaggtcgttcaacctgaacagatgttaggttatctcgcccatatgtcgcgggataatgcgcgtacaccgatgcagtgggatgatagtcagaatgctgggttttcaacggcaacaccgtggctagcggttaataccaattatccgcggatcaacgcgcaactcgcgcaacgaacgcccggttcagttctgagctattatcagcggttgattaagctccggcaccatttaccagtcataacgacgggaacttatcacctattatcacctgatgatgcggccgtttatgcctatatgcggcatatggggtcgcagcacctgctagtaatttgtaactttactgcggcaacccagacgcgacactttgcagaattacccgctgatgcgcatctgttgatcagtaactacgatgaagatcatcaagacgtattacgagcgtacgaagcaaaagtttaccagttttaggtcacaattagcttcgctgctggagtcgtgaatgtgatttttaacggcggttgtgtgattacgagcacgagttggtcgtgtaaatttaatcgtgatgacttaaccaaaaatgcgccccaataagaacgcccaacctatcattctagataagttgggtatttttattggagcgcatgtgtgattatgatcaagtttgtggttaagatttttgttcggcattgtcagcctcaaatgttttttcaataatgtcgataacctgtttgactaagccaattggaaattggtgggcccgacgaatcaagttgatatgcacgctaggaacctgaacgtcgtcgaacggaatctcaacgagaccatcgtcttcaccatcgttgggggtcgtgatgtcggaaatgaagcctagtgccaggttctctttaactaatcccttgatcaaggtgctgctatcagattcgaagagaacttggggttcaatcgaaagttgttcagcaagttgccggaagactagtttatttaagtaagttgcattaagcagtacaaaaggcgattttagcgcttctgcaaaagtcggatgctcagcctttgctaaggggtgcgcaacattagcgagaatgcgaaatttaaaaggccgtaatggcgttactgctagccgttcatccaatgtttgatccaagttaccactgatggctaagtcgagttggccggctaaaacctgtttgacgagttgattagcccccatttcaaccgtgtggacgctactaagcaaatcttgctcgatgattggttttgttaatgccggtaaataatgttcactgacggatggttcgataccaaaccgcagtgtatgttgacgcaaatgactgattgattcattgacatgctgccagttgttgataatgtcgttggctgcgagcaatagttgctagccactaggtgttaacaccagcgccttggtctttgcttggcgaaagaacagtgtcacttgaaaatgacgttctagtcgtttaattgcttgggagattgtgggttggctaacgtgaaaatcagcagccgtttgcgtataactctgagtgctgattaagcgttggaagtaatacaagtctttaatgttcatgaaaaatgtagcctccataaaatattaatgttggttgcgcaattaatagtcgcaggtaagcaggctccgactgattgattaaagctggttattatacgtcatgttaatcataccattgttataacgaatagtgtcaggataattagtgaaaattaatttacaaaatagttaacgcgcttaaactataatgattattaataagaatgttagtgctgattggtacagatgtagtgttgctggtaaattaggttttgagtcattatataattttatcagttaaagggctgccgcatcgttttgattatcatgacgtgtcggttggtctgattaatcaccggaaaaaaagttgcattgcttaagtgggagtcgttagaaataaaggttaaagtgttaaagcgataagtaaacattattcagattaagaagcatacaagttaatggcaaactattagtaataaagctataaaaaatacttatcagttaaggtgctgttatatatcgctcgataaatcaataattggtctacgtgccatcggtagcgccagtctgccccgtttttcgacgtaattagttgacaagcaactaaagcagttaatgggtttaaattataaatgaaacgaatgacatcatttttactgattgcaattagttaaatctatattaatcagcataaattattttaattagctaacaactgtcacgaactcgtcaaaattgatggcatacaacttttgtataaaatattataatactaattatgattaatgtctttaaaatgttgatatatcggtaaattaattaagtgtacataaataaaaattatatagacgtaatgagccttttgaacaaatattgctggtatgtaactgctatctgtgagcgacgaattttgacaaaaagtgtcttcaaatttgcggaatgtggtttataattaaggcgtgtaatcggtttaaaagttttaacttatataagaaagggggggatatcatgcgattaatcgatttcaaaacttggataatgggaacggccgccatgttgacattgattgtgacaaatcaaacagtgagtgcggcggacacggctaccactgccactgaaacgacgcagacttctggctcgagtacacttgctaatcaagtggtgttgcgacaaactacgtgcagtagcagtagcagtagcagtagcagtagcacgaaagcatcggcaactggtgcggcgactgaaacggcgactagcaaagcggtcaccacgtctgagtcatcaacccaatcatctagcacaacagctactagccaaacgacttcaggtgtgacagccgctcaggcaacaacggacagtactgatacgacagcgacgtcccgggcgacggctaatgccaaagcggatcaacgagcggctagtgcgaaggcgaacaacgagcaagcaacgacccagaatcagcaacaaacgactaatatgtacagtggtgtcgttaccagtcaaaaagactcggcgagaacggcaactacgacggatcaatcaactgcgtctgtcgcgacactgtccagaatgagccgggccagtcttcgcagtttagcacaacgggcaacggttgcggttcaggggctcgatgctactgacgcaacggtgactgacgatgatggtgttacgtatagcgctacggatgtattgagtctgtatgcgaactatatcgcgaagtatcattggtcaatagccgatgatgttagcgtaactgctggcagtacagcaacggtgaccttacccgagaatgttgtctttaccaatggtacgcagcatattgatgtccaaaaatcagatggaacggtcgtcgggacttttacggccgagaccggtagtcaaaccggaacactaacttttaatgattattatgcgactagtgatcgttataatcgtcaaggagacttaacgttttatgttactgggactagcgcaaccactggcagtagtacgactgggattaataaggttggctgggccgatagtaatagtttagatgctgatggtaatcccaccaaaatgatctggcaagttgtcgcaaacattaatagtgaaaagtggcagcaagttgcgattgttgatcagctgggcctttatcaaacgcacgaaggtaccatgacgttggaaactggtcattatactgacggtgcctttgttaaagacgcggcactgggcacttatgattttgcaacgcagcagtttacctacgctgatggggtatcaacaccacaagtaaccgtgacggttgtgggtcagcagatgacaattaatattgaccaattagatgtagcggtcaatatattttatgaagttggtctgacagtaggacatacgtacaccaataatgcgggtgtaacgtatgcacctgtcattggagatgcgactgatccaaatgagggcagttcgacaggcgaaccaaagagtgaacaatcgaacgtggccgttagatttggtggttccggaactgctagtgatgacattcagagttacagtttggtcattaataaaactgatggtgacggccagtcagttgctggtgccacttatcagttagaggatagtacgggtacggtacttcggaccgatttggtgactgattcagttggacagttacgcatcggtaacttgtcggctgggacgtacatgctagttgagacggcggctccgagtggctaccagatcgacacggccaagcacgtcttcacggtatccgcagtgcaagcaacggctaacgtggtcacaggtagtgtggttgacaaacgaatggctaagacggggctgactgttaacaaagtttgggctgacgtgccagctggagtgcaaacgccgaccgttgaagtgacgttgcaacgcaatggtcaagcttatcagaccttgcaattaacgtcagcaaatggctatacgggcactttcagtgatttggatgtgacggatgtttatggcaatgcgtacacttatacggtgattgaaacggccattgctggctatatcagtagtcaaacaactagtggtgagacggtgacattaacgaatacgtatcaaaccgggaaattgacggtggttaagacggattcgagtggcgccaatcgcttggccggggcggtttttgccgtgaaaaatgctgccggaacgctggttgctcagttgacaacggatgcgactggtcaagcacagcttacaggtctaacgcaaggcgcttatacggttagcgaaattcaagcaccggacggttacttgatcaatacacaggcgcaagtgcttgtgttgaatgagcaaagcgcttatcaaggccaattagtttttgccgatgaggtcgaaccaagtgaaccgagcgaaccaagcgaaccgagtgaaccgagtgaaccgagtgaaccgagtgaaccgagtgaaccgagtgaaccgagtgaaccgagtgaaccgagtgaaccgagtgaaccgagtgaaccgagtgaaccgagtgannnnnnnnnnccgagtgaaccgagtgaaccgagcgaaccaagtgaaccggtgctaccaggacacgctgacgaggatagtgattcagatcaggttgtcacaacgaagactgagacagctaagttagtcaagcaaactaatttagtaaccacgactcggccaacgaaattgttaggacagccaataaaattagtagcaacttctaaaccagttgttaaagttacaaaagcaactaatcgcaagtcggcgcaacaattgccacagactagtgaacaatcaatggattggctaatgattttgggctggttcttgctagggctaacagttgttagtcgtcaacggcgatttaattaaacaaaaaggctactggaatttcgcttccagtagcctttatttatatcatagataagtgtcgccacattatcgacgattttgagatgtgcgttggtcatgcttaattctgactggttgggcagcgggaacacgggcgccagccacgacgccggcaacggcagctagtccggctgcggccaataaacctgctaataacatgggcaagacctcctcaatagttgtaaaaaatcgtcttttaatacttgcagtttaggcgacttattaacaaaaatcaattatttaaccgtaaattagtgagaatctgaataacttgaaatattcttaagtaattgccggttattgttcattctggcaagggcggccgcatcatttaaatattcatgaatttgatccggttcatcggataattgagcctgtaagaatttgatccgcgctgcgtaataggtaacgtggaatcgcgcacaaatctcaatcccgtagtttaataactgcaaactccgcggtgtatcattaatgttagcgtaaaaagcccccgtgtaataagctaagttaatcacgcgccaaacactagcggtcgtttctagcggtaggttcggtagggcgtggcgtactttttcaaaatagtactgggctttatcgttatcctggttctgctgataagcaatcccgataccacagtaggccagctgtgtatagattgtgatgtgagcctcgtccaaatcggtgatgatttggtcaaaattaaagatgacatcactgatcgggtggtggttaagggcagcaacatagccttttagataacaatattgtaatttggtttcgcggtcatgtcgcggcatatccgcagccttttcaagttgtacttcggcatcttgatattcagttgtaatgaggtcgaactcgacctgttccaaaatcttcaaaacagcggcatcagcgacgcgttcggttggaaagacatcttccaattgtaggttgagtcgctgacaaagttgggcaacgattcgtatggcaggtgctttgccattgttctcgaacttacttagtgtcgcctgagtacaaataccatctgctagggctttttgtgaaagtcctagggctttgcggcgggcgatgaaaagctcaatgttcataccatcaacgcttcctttacatatttaagtcataattgaaacagctttcatttaccctaattaaaaactttttatataattttgtcaatatttaaacataatcttgcatattctaaaaatatatcttgactatataaaaaacgctcgctagtctttgctagtgagcgtctgtgagttatctgatggtttattttgccatataggcgtctttgaagttatagttggtaccagaagtgttataaatcaggccctttaacttagggttgaccatctgtgccagcgttgtttgagttaatggtgcaacgccttcatccgtcccaataattttttcagctttgcctagagcagtccagcgtactgtcggatcagttgcttgctcggcctgcttgacagcagcgtcataatcagcatttttccacttaccaaagttgtaatcattcgtggaagtgagaatgcctaggtcagagatggggtcggcgaagtcagcttgccagccagaaatagcgagttggaaatcacccgatgtttcacgtgcaagtcggtttttgaatggcaaggtaatatcggtaatcttcaaaccgggtagttccttttctagctgtccctgaacatattcggccgtctctttggtttggtcaatattatcgtgcgtaagcgttaaggttaatgactttttgccggtttcttttaatccttctgcccacagtttcttggccttagcggtgtcttgagttgtcgccgcactaactgcattttcagtagcgaaatcttcaccagtcgttggatcggttgcgagcccggtggtgacaaagccctttggaactgctgagccatccgctagtacgtccgtgacaagttggtgccggtcaatagttaaggacatcgcttgccggagcttggcattagctagcgcgggcacctttttctgattaaactcgaggtagttcagacgggatgtcttacggagcactaacttgggattattcttttcgtttttgacttgttcgccgctcagggtggccatgtcgagtttgttgctctggaataagttgaatccggtcgtggttgacttaacgacttggtcattgatcttttctaagtaaacgtgttttttatcccaatatttaggattgcggttcagggaccatgtcgtattagtgcctttccagcccttcatggtaaacggcccatcgtagaccatcttggtggccgttgtcccatagtccttgccgtatttctgtacggcgtgttggttctgcgggaagaagatggcaaagcccattaggagtttaaaataagccatgggtttatcaagtgtcacggttagcttgtatttaccgtcagctttaattcctaaactattggctttagctttaccattggtgatttggtcggcattcttgataccagaataaagataagcatattgcgaagcggtcttgggatcgatggttcgccgccaactataaacgaaatcttgagcggttacgggatcgccgttgctccacttggcgtctttgcgcaatgtgaacgtataagtttttttatctttggaaatgacagtatgggtcgcaatgcccggtgtgattttattattattgccaatacggtagaggccctccatcgtgttattgatcatattggcactgatcgaatcggtgactagcgaagtatccaaagtcgttagttcggagccattttctgaccagttcaagacttgcttttgtgccattcccgcgcgtaagttccccgcattatctgacttggactgaccttgactacaggcagctaacaaaaggccggtcgatgcggccgcagtagcagttgtcaacattactttccatttcatagtaaaacttccccccaacttgaatggtcacgagaatacattaaagcaagattaaaatcaatgctttgattctaataattaaagtaattaacagccgcaaaatgtgtcaagaaacacaaaaaaagtaccgtagtttgttgctacgataccttttattgtgcgatttaagggtagtttgacgtgaggcgatgctagttaggtcaccttatttggccatataggcactcttgaagttatagttaatgcccgccgtgttgtagactaggcctttcagcttagggttgaccatttgtgcgatgacgttttgtgagagcggtgcgaccccttgatccgtcgccatcgtcttttcagcggttgcgagagcttgccaacgcttcgttgtactggttgtactatttgctgtgttgatagcactatcgaaagtcttgttggtccacttaccaaagttgtaatcgttagttgatgtcatgataccgaggtctgaaactggatcagcaaagtcagcttgccatgcggagataaccagctggaaattacccgcaatttctcgggaaattcttgtcttataaggaacggtgacactttgcactttaagtcccggtaattccttttctaattgtccctgaacgtattcagcgagggccttcatctgatctgtatcgtcatgagttaacgttaaggtaaccgacttcttgccggtttcttttagtccttgtttccagagctttttagctttggtggtgtcctgagtaacagctgatttaaccgtattttcggtggcgaagtccttaccagtcgttggatcagtagcaagtccggtcgtaacaaagccctttggagtgacggaaccatcgccgaggacatcgttgaccaactgcttacgattcaaagtcagtgacattgcttgacgaatcttcttattggcgagtaacttcaccttcttttgattgaattccaagtaatttagacgtgaagacttacggatgaccagtttgttattattcttttcgttcttgacttgttgtccagataacgttgccatgtcgagcttattactctggaagaggttaaaggctgtcgtcgtcgacttcacgacttggtctttgatcttagttaagtaaacgtgttttttatcccagtaattaggattgcgcttaagtgtccaggtcgagttggtccctttccaaccagtcatcttgaatggcccgttgtaaaccatcttgctggaactggtcccgtagtcctttccgtatttttccaccgcgtgctggttttgcgggaagaagaccacgaaacccatcaataatttgaaatactgcatgggcttttcaagtttgacggtcagcttatacttaccatcggccttgatgcccaaggtactagtcttggccttgccgctgacgattttgtcagcatttttgataccggaatataagtaggcgtattgggaagccgtcttcggattaactgtacgacgccagccatacacaaagtcttgtgcggtcacttgatcgccattactccatttggcatttttacgcagggtaaaagtataagtctttttatctttggacacgatcgttttagtggcaatacctggtgtgaccttactgtttttacctaatcgatacaaaccttcttgcgaattactgatcatcgtcccactgataacatcagtggctaaggacgggtcaagggtggtcaaatcctggccgttttccgaccaattgaggacttgagtcctggccattttggcagttgtgttgccggcattgcttgaactggatgaggactgaccacagccgacgagtaaaacgccggtcgttgccgttaacgtggcaactgtggcaaataatttccattgcatatatgtaccccctgcttcaaataattatgatatgtagatgagaatacattaaaattagattaaatacaatattatttttttaatcattaatattattaagcaaataaagccagtacgactcgttaagaatcgtactggcttaattaagaaaactaacgttgccattgcatcgtatattctggttgctgggttgcttggtcattagcctgatcaatgacacggaaaccgtgatagtgataaaaggcaatggctgggcgattagcaacatagacgtttaattgtaattgatgatggtcagcttgggcagtcgccaatagcgccgtccccagaccttgatgttgagcatcattgcaaatgaaaattccggcaatgtaatcgttttgtaagcctataaagcccagaatataagcttcaggtccgtcggtcagtccgacgatgagttcggctgattgtaatgcttcacgtactaagggggcttgttgacgccagtagtcggcactgacaaagtcatgggccgttaaattaccacttaaccagattgtcattaactgatcgagttggtgagttgtcgggtgttgtaagtgttcaatcttcattcgacgctaccccgttttaatagtcgaacgcgactcactgccggaattttagacagttcagctattaggtcggcttgttgtggctgctgtaggtcgtcgacgtcaatgatggtgtaagcaatctggtgcttagcggcgttagccatggtagtgatgttgaggttggccgctgctagtttggccgtgatttgactcaccatgttaggcacattttcgtgaatgactgtaaagcggtaagccgcgttgaacgggacgtttaagtctggcagattgatggccgcatgaacgttaccggtttccaaataagtcatgatagtgcgcgcagcttgtgtggcaccgttgatttcagcctcgatagtcgagccgccgatatggggtgtcacggtaaccgcggattggttggcaagctggggttcgccaaaatcggtgtagtagtgggcaacttgtcccgtggctaacgcattcatgacggcagtattgtcaacgatgcccagccgtgaataattaaataattgaacgcctgttggcatggcggctaacgcatctttattaatcagatgaagtgtgtcggcatttttaggaacgtggacggtgacaaaatcagcttgtttgactgcatctggcagcgtggccgctcgctggacttgtttggcaatgttccaagcggcatctgcagatagataggggtcgtaaccaattacattcatgcctagactcaatgctgcattggcaacgagagcgccaacatggccgagtccgatgacggccaaggtcttacccgttaattcaataccattaaattgcgtcttgtcgtgttctgtgcgttgagaaatatcagcttctgtatgctgggccgaataggtcgttgcagctattagattacgggatgccataatgagcaggccgatgatgagttccttaacggcattagcgttacttcccggggtgttgaaaactgcagtcccgttggcggttgcctgatcgataggaatgttgttaacgccggcaccagcgcgcacaatgactttcaacgatgacggtaatgtctcggtatgtaggttgaccgagcgaattaagtaagcatccggatgctcagattgattgagcgtgtaatcagcagtaaacgtgttgaggccggctggggcgatggcgttataggttttaacttgatacataaatatcctccttgattaacgatggtgtgcttcaaaagcggctagatagtcaactaatgcctgaacaccggctaacggcatggcgttatagaggctggcacgcataccgccaactaagcggtgaccctttaggtttaataacccgtgctcacgggcgccttgaatgactgcggcatcgaggtcggcctgacctgtgacgaatggaacgttcatggtcgaacggtcgctggtcttgactggattagtaaatagttgtgactggtctaagaaatcatagagtaaggcggctttagcgtgattgcgagcagtcattgtgctgagcccgccttgggcctttagccacttgagtacgagacccgcggcgtaaatagcaaaaacaggcggcgtgttgaacatcgaatctttagccgcgaatagctggtaatccagcatgcttggcaggttggcgacttgaccaattaaatcatcacggacaatgacgattgtcaaaccagcgggacccagattcttctgagcaccagcaaagatgagcccaaaatcgctgacttggtaaggttcacctaaaaagtttgatgacatgtcggctaccagtggtacttgacccgtaactggcaggcgcgtcatcatggttccttcaatagtattattagttgtaagatgaatataatcgagggattgatcgatgggctggacgaccgttggcagttggttaaaatggttggcagcgctactccccagtatcgtgactttagtaccgacccgtttagcttcatcggcggcgcgttgtgcccagtgaccgctgtcaagcaacccgatacgatgatgaggcgccagatttagtggcgcagctgtgaactgtagcgtgcccccgccttgaaagaagagcacgtgatagttgtcaggaatggccattaaatcgcgaagatcttgttcggcatcttgaaggacttgcgcaaataaatcggagcgatgcgagatctctaaaatgctcatgccggagtctcgaaatgatggtagctccgcttgaatttgagtgatgactggttgtggtagaacggctggcccagcagaaaaattataaattggcatgaaaaatcctcgctttcagtagtttaatcaaggtaataaaaaagtcctcgcagtcggtttcgactaccaggacggataataacgagattaagcaattccacctggtagcgaatgtcttagcatccgtgctcaggctgatttgcgtacgcaaaattaggccgacacagatgggtgtgtagaccaggaggaactgatatgatgattgataggattagttagaaccatcagttggacactccttcgttaaactggtgttggcaccagtcagttaattgcgttggtattaatttagcaagcacgtaactatttgtcaagctagataatgagaaaagactgtggcacaattagtattattaataataatttaatcttggaggcgcacgatgacaaccttttacgtggtacgacatggacaaacagtggccaacgcccaaaatttaaaacaaggcacgattaatacagccgtcacgcatttgaattcggttggcaagcagcaagcgcaaacgttgcacgatacgtttgacattagcttcgcggatcggttgatttgtagcccgcttgaccggacccaggccacggcggcgattttgaatcaaggccggcaactacctgttagccaggacgagcggttattggaaatttcatacggccagtgggatggacaggataatgatcagttgctagcggcctatccgcagtactttgatccacttttacaggacgttttgccaagctacgtggaggttgcgacggatggcgagacttttgagcacgtgcaacaacgggtagcagcatttttgaagacaacagcacaagcccatccagacgagcagatcattgtcgtgacccatggttttaccgtcaaagccatggccttagcgatactaaagccgaccgatccgatgagcttaccggagccagctaatacgagcgtcactaaagtaatggtggatgctgtccatggtcgccaatatttagcatattataaccgcctacctcaattctgacgcgcaatgacttaacgaacgggcgattccgggctacaatagatggtggtttgaaatagccacgcactgttgaaccttatttcaaatcaaagtctaattaggcagcaacagcagacatcacatataaactcctaagtgaggtggtcctagcatttggcgaggatcgcccttttgtatccgcttaagcgtttgatcagtaccaatattacaggcgcggtataatataaatagtattcaaaaattagatgaggtgagtaatgatgacatattcagcagcatcaacgcgctatgacgaattaccgattcgacgcgtgggtaagacggggctacagttacccgttgtctcgttagggctatggcgaaattttggggatgaagcgccgtttgccaattcacgaaaagtggttctagatgcctttgatcatggcgtttttagctttgatttagcaaataattatggaccatcgaagggatcggcagagcggacgttcggacaaattatgcaacgagatttaaagccgtatcgtgatgagctcgtcatcacgactaaagccggatatccggcctggtcagggccgtatggggctttcggctcacgcaaaacgttgatcagttcattggatcgtagtcttaagcaaatgcatttagattacgtcgacattttctactcacatcgtccagaccctaacatcgatttgtatgaaactgccgcggcccttgaccagttggttcgtcaggggaaggcgttgtatgtcggaatttcaaattatgaccgcgaccaaacggcaacgatggttaagtattttaatgagatgcacacgccgtttacggttaatcagtactcatataacatgttgaatcaacaggctcaaacaacgggcctgattgactatctcggccagcataatgcgggcttggtggcatatggtccattagctgaaggattattgacgcagcgctacttacaaggaattccagccgattttccgattcatcgaacgaataaatatttatttgatcaggagactgcagccgttgtcaatcagttgaatgccctgaacagaatcgctgagcaacggggacaaaccttggcccaaatggctttggcttggctactacggtcacaggtcgtcacgagcgtcatcattggtacgaccaatgtcgaccacttgcacgctaatcttgaagcaacgcacaatttaacctttagtgatgatgaagtaaaagctattaccgcgattctaaagtaaattgcattaaaggccactcccccaatatgccggggagtggcctttttattagcgcgtcctgtttattaaggtcaaaaatagctcactcttaggctcgttaggtagactcctgttcttcagcaataatcgccctatttccgacctccggggcggagcgacaattgctggaacgtaaaccgacatcgatttgagcccgaacccgcccagtctcaaatacgagacttattctaagctggcggcttttgaatttaatgacggtcatgttttgaactgagccatagccgtgcgctaacttcaactgaccgaatccgggcaattttaaaataatttgggcgaatgttcggtaacctcggtagttaacggcataattagttagctggtgaaattactgattggtacaagtgaccggtttatcaacgtcatcaaaatgtaatagtttttatcgaacgtacgttctaaaaatgtgctatgatggagctactatttcgatgaggtgatctaatggaacagctgaaaccaattgaagcgtcgttattgcaagcttatgagttaaactgcgtggttcggttaactttaagtgatggtcatcagccgagtggcttaattgcggctgtggacgaccagcagctttttttgaatcaacaagcgggagtcgttaagccgattgcgttgagtgacgtaaccgccattgattttcttaaacagtcttggtggcagcggtaatcctaaaggtcgtatttcgctatgatttcgtgacgacggaattcggtaatagcagtaatcaattcaagtggtaggggctgatccagcggaaactggatggcccctttgcttgttttataggtgattaattgatcatgaaaagtctcaattgcacttggcgttgggtacaagccaaagtgatgtttgaataaagcaaaatggatgacgttttcgtgccaatagaaggtcggcatctggtactttaactgctcttgcgcctctggtaagaccgttgcaatggtttgctgtaaggctattaattgcgattgataggcttgtggtgtgttagcaatataggcctcaatcggcgtcatggtgaatatcttcctggtcacgtaagtcagcagctaaagtagcatcagggacaacggtgatcgtgcgtgcaggaccactaaaggtgacaagcccagccttagcacccttgggtttacgcatctggccaacggtgagcacatcaacaggtacgcggttcatctgacgacccttactgtaataggccgtcagtacggccgcttcctgcaaggtttgttcactcggatgattactgtgaataaccacgtgtgaaccgggaatttcaccacccgcgtgcatccagtagtaatctttacgggccgtcaatgttaggtggtcgttttgacgactatttttaccaacttcaaccagcacgtggtcgtgcgtgtaaaagcggcggggatgggcgggtgttggggccttagatgagtgtaaaacgtgggtatgaatcgcgcccgcagcaatcagtgtttgcttaagcgcggcgaccgcttgtggatcattagggtcgaaagctgcttgagttgctaattgctggtatagttcggtcttggccgtcgccaaattttgttgaacggtcgcttgaccgcgtttgcttttgtgataacgatgaaaataatcctcggcattttcaataattgattttttaatatcgagtttaatactgagttggtggccttgatagtcgggcaattcgacgaaatgatggtgcccctcgatctggctagcatacgtcttcaataacgtgcccttgagttgcaaatcactgacatcaggcaggtggtctaatgctttagttaatgattcgatttgtttacgcgtgtggtgaattaagtgcgctaatccagtttggactaggtcgacatcggttgtggtcgtcattaattgggttcctctaatctgtaaaagttaacgtcttaataataacatgttctggttagttaacagtggaagattgggactagcgaatgaattaagatgtcaaatgacacgattgaaaaaagttgagcaattttcagaaaagttcggtattctattacatgggagttgattgagaaatgcaaaaaacattaattattaacgcaggtagttcatcattgaaatggcaattatttgctatgcctgctgaaacggtggttgctagtggtctcgttgaacggattagtatgcccggttcaattttcaccatcaagtatggtgaccatcaaaagtttgaaacgacagtcgataatttagatcaaaatcatgcggcgcagatgttattggctgaattacagcgattagcaattattgactcattaacggaaattacggcagttgctcaccgagtcgttgcgggtggcgaaacgttcaagcaagcagttgaagtgacgccagcggtactcgaggccattaaggggcttagtgactttgcaccattgcataatccgatggaggcacgtggtattgagacgatggctcaggctttaccgaccgttaaacagtacgcggtatttgatagtcaattctttaccgatttaccagaaatgaatgcaatttacagtttgccatatgaattgacccaaaaataccatattcgccgttacggtgaacatggtatctcgcatggttacttaaccggtcgggctgcagaactgctggctaagccgaaagatgacctcaacctggtgacgttacacttaggtagtggcgcgtcattagctgccgtaaaaaatggccgggccttcgacacatcgatgggctttacgccattaacgggtgtcacaatgggaacgcgcgcgggtgacgttgatccggccgtattgccattcctcatgaaagctttaaagatcgatgatccgaatgaaatcatgatgatgcttaacaatcagtctgggttgttaggaatctcaggaatttcaccagatatgcgtgaaatccgtgcgcaagaagccacgaatccccaagcccaactagctgttgaaatttttgtcaatcggattgttaagtatgccggtagctatttgacagaattaaaacgggcggatgcgctgatttttgcgggcggcattggcgagcataatgcgaccttgcgccagcaaattattgatgaactgagcatctttggtgtgaccctggatccgaaattaaatgaagcgggtcaagaaggactcatcagtggcgcagattccaagattaaagtgatgttgatcccaactaacgaagaattagcgatggtgcgacaagttgcggcgttgcaaaattaagcttctcttaatttacgactgcaatcagtctgccgctgtatagcgcgtgctatactaactggcaaggtacccatgatgggacttgtaaggagggaagctctcttcgcagagcgcatagatgatcggtttattgattgctttagtaattggtttatggttgctcaaagttatctttaaaattggttttaaaattatcggttgggtgttcatgattgtgattgggttgtttttatttaaaatcgcattatggttaggcttgatcgtcgtggcgattgccggcgttgcattattcggaaatgccaccacgtaatttgaaagataaagatgagcgttgttaaaactagtgtcatcggcacgctagccgtaaaggcggcttgttggaactaaatagtcattgaacaaaaacaggaaatctcagttagttttgtgagacttcctgttttttgagttagattaaagttccgagataaaccatgactaggccaccgacgagactcaagccaaagtattcccaggcgacccgttgatggtggttacggccgagcaacacgagttcgttgatcattgttgaaaaagtcgtatagccacccataatcccagttcctagaaaaatctgccagttgggcggtaatgagctggttaaaatccaaccgagcaataaagcgccggttagattgataaataacgtggcaattggtaacggccatcgattgagaggtagtgctaagcgcatgatgccgtaacgacttaaggcccctacagctgcgccggcaccggccaatccgactaggactaacattaaaattcctcctttggtagccaataggtgctaaggaagtttccagctagccccgctagcaaacccaaccctaagctagcagcgacataacttaaagctaaaacgctatgaccactttgaaacgattgtagcgtttcaaaagtgaaggtggaaaaagtagtaaagctaccaacgaacccgacgctcataccgataacaatatcttcagagacgggtaaccgcgctggtaacaagttagtaatcaggctaagaacaaatgctcccacaatattaatcagacacgttatccagaaatgctgtggccaagtgacgagcaaactaagcccctcccggagaccaccacctagcattgcgaagccggtaattgcaatgatctttttcaagctgacacctgctttctgaaagtaattttagtttactgaaaaaacttttaaaaaacaatggttcttgcaaattgaaattaaacatgctaatctacaaagtaacttataaaacacgaggtattcagccaatgcgcaactaattaattctagtaactgaacagagccatgcctagcgataggggtggactgtccgttttgggattaattagggtgctggtggaatcaattgccagcgttctcattttgaggacgtttttttgtgccataaattagtccctgcaactaaggggatgcttattaatgacaatgattaatttaaaaaatattcaaaaagatatggcgggacggccactatttacaattgaccgattagtcgccaatgccggggatcaaatcggcgtggttgggcggaacggtgctggtaaatcaacactggcccatttactgacgggtactgatcgtgattatacgggacaaattatggtggacgagccagtcagctatgttgcccaaatcgcaccgacttttgaccaaagtggtggtcaagctatgctaaccagaattcggcaggctttgagcgcccggccaacaattttaattctagatgaaccgtcatctaatttggatgaaacacatcagcaatggcttattaatcagttacaacgttttcgtgggttgctgttgttgatttcacatgatcggcaattattaaatgctgtgacgacacagacttgggcggttgaacaccaaaaattcaccgcatatgcaggcaattacgcatattatcagacggtaaaagcgcagcaaatcgcaactcaggaagccgcgtatcagcgccaaaacactcatcagcgtgagttactagcagcgcagcgtcaacgtaatgaaaaagcgcagcggattcgaaaaggcaatcggcgaatgtcgcaagtagagcgtgccaagacgaaagcgactagggaagctactgcggccaagatggaacgaacggctaaacgcatggtcgcccgaggacaacgggaaccgcaagttgctaagccctttacgacttcaggctttaagttagtcgcgacagattttccgacgtttacaggtaagaccgtggtaactggtcttaatgtcacattggctgaatatggaaaaacgttgttagcacaagctgactttcaaatcaggccacatgatcgggtcgctatcgtggggcccaacggtagcggtaagaccacattactgcgtgtaattttaggtggccgggtgtcaggattacgattggctccggcggcacgagtcggagtattcaaccaagatatgacagtgctcgacggtaaacagtcagtgtggcaaacggtgcggcaagtcagtcagctaccggatcaaacgatccgtaacgtcatgggcgcgttgggcctgccagcacgcttttatccgcaactggtatcggcgttaagtggtggtgaactagttaaattacagctaattcgtattttagtcggtcaatataacgttttaatgttagatgaaccaaccaattatttggatgtggacgcgctggatgcgttggccgattacttacaaaattgagagcgtaaaatatcttgnnnnnnnnnncaagattcttgacgctaccacaaaattatcctggaaccgtaatttttgtttcacatgatgaaccgtttcgccaggccgttgctactcgggtgttgcaattcgagacgcaccaattagttgatcctgacaaagttgttaaagcgccgcaaccggtagaagctgacttagcagtacttcagttcaagtatgatcaattaatggcagacccgacgtcttctacagctgctattcaggcgttacggcaacaaattgatcggctgaaagcatgaattaaggtcaacttgttattgttgtgacccgacctaagtggggaatattacccaaaaacaggttttctcataattgagaaaacctgttttaatttagtgtttattcagtgaatgataccactagcgccacggaatgacgaaggcgccgacttgtaaaagcaagacgccactaatcacaatggtccaatccaacttagtcagtggaatctgacgatagtgagtgcggggtgcatcttcgacaaaaccatgggagcgcatggcctgggcaaggttctgcgaccaattgatagagaccaaaattgctttaaagtagagctgtggcgaccagaaggacaggacctgcccacgcatcagaccagcagcccgaatcacttgaacttcgtgctgaatccgtggtaccaagttatacgcggcgaggacgccatatgcaaatttggcgggtaaatgccagttttgctcaagcgaatcggttaattgtaagacgtcagtcgtgagcgtaaaagtagcgcccgtaaaaacaaacgcatagatccgtgtgaacaggacccaggccatcaaagtcttgtcaccgctaccgttaatgtactgggtactccaaagtccaattgctggtagcaacggaatgagtagcaaccaccctaatgttcgaagccgagttcggtgaccgagcaggtaaatcagtgccagaataatcagtgccacgttcaaacttacaattgtcgtgaatgaaatttctagcgcaatgatgagtagtaataataatttcatgctaggattcatgatcgcaccacccaatctaaatggtgattttcaaagtgtagctgatagtcaatcaatggcatcaggccggttaactggtgactaataataatcagcgtctgcttagttgccgcttgggtggtctgtaataacgcgaccagggcattgatcgaatgcaaatctagcccttttaagggttcatccatgagtagaactggtgactgcatgattaacatgagcagaatttgtagtttctttttctgtccctcactcaaagtatagatgacttgttcatcacgaccggataagttgagttgcactaaggccgtttgaatacggtctgcggtaaagtagtcgccacacgcatagcgtttactttgagccagttcttcagcgaccgtgatgtttaaaaactgggtctcagcgtcctgaaaaagcaaggcgacgtggcgagcatagcgtttgcgttttagcttgtcgataggtgtcccttcgtaacgaatttcgccagtataggggtgcagacggacgagggcttcaaataacgtggatttaccgctaccgttaggacccgtgatcagcgtattgtgttgtgctaacaattgacgcgttgtcggtactaatagttgacgatcacctgcctgtaaagtgacgtgatcaagttgaaaacaagggcgttcaacgcgttgcggtgctgaccatgaccgttgtggctgctcagtaaaggctgcaaataactcagaccaggtggtgcgatcaatgagctgtaagtgctggtccttgatttggacgacttgatcgacgagctgttcgtaacctgataggtcatgatccgccaagatgattgtcttcccatgttgattgcgtagttccacgagtcggtctaacaagacggctcgtgcggtcggatcgacactggcaaagggctcatctagtaggatgacatcgctatccatagcgacaatgattgcaagggccactttctgtttctcgccaccggataaatgatttaatagtcgtgactgtaaatttcggataccaacaaagtcaagcgcactaagtaagcgggccggtatttggtcacggggcacttgtaagttctcaagtgcgaaaattagttcattttcaacggtatccatggcaaactgctgattaggattctgaaacatcatggcaacgtgctgagcgcgctgattagcggtgctagcagttaatgactgaccatcaaaggtaatggtgccgtaatctggagtcaggggtagtaagcctgcaatcagctttaggagcgtcgacttacctgttcccgatggccctgtcaataggatgaagctttgccgtggtagtgttaggttaacgcgatccagaatgggtgtcgacgcctgtggataggtgtaagttaaattattcagcgcgatactagccattcgagaaagcctccattttataaagtgtattaatgcgttgattttaaaacatgactgcgatcaagtaggtccgtgatggttttagttaacagacccccgaaaacaaacatcgaaataaagcgaacgaccacgtataaaaccaagagccatagctgtaatttatagtaaccattacgggcaaggtcccagccaaaggtgaccacagtagttgttgcggccgcagccgttaagcctaaccagtcatagtgtttgtagccagtgacgatataacctagttcggccccaaatccttgcacgacaccagaaatcaatgtggtgattccccattgaccaccgaaaaacatttcgacggttgctgcgaggagctcacctagcgttgccgaaccctttagtcgaatgaggtagccagctaacatgccgggcatgcaccataagccaagtagtagttcattagccagaccgcttagaccaaatggtgtcagggccgcacttaaaatgttataaacaaaattagtccccataaagatggcaccaaagaaaataccaattagtgccagtaaaataatatcgttcaagtaccatgatttaacccatttcattgttaaatcctcccaaaagtagtttgtcattcacgcatccaagcgacaaaaaacgcctaccacgattatcggtggcaggcggctaagtctgaattgatggttccccaaataaaagcattgctccctgcgctggcattgtccagattcaggttcaatgggtattatctcagccgtgatggcaccccagttgctatgaatgatacgtttagtgtaacggataatgacattcagtgcaatcaattttccggaaactaaagcaaagtatgatgaaaagtcacaattttgtggtttactatggataaagcaatgtatttggttaatattcttaggagggatctcgatggcagaatcagtgtatgattttacagaaactgagatgagtggtgcgccacttgacttgtcacaatatcgcggtcaggtcttgctaatcgtgaatacggctagcaactgtggcctggcgccacagtttaaaggattagaagaactttatcagaagtatcagcaggagggcctagtggtcttgggattgccatccaatcaatttcatcaagaaaaggcggatgacgatgagacccatgactattgtcaacggcactacggggtaacgttccccatgaccaaacgggtgatggttaatggtgatgacgctgatccgttatttacttacctcaaacaggcggcgggacatggtcgaatcaagtggaatttcacaaaattcctgattggtcgtgatggccgtgtgctcgaacgctatgccccaacgacacggccggcaacatttgaagcagcgattcgtgatgccttggctgatcgttcagaagattaacgataaatttaacaatgatcgtttaatttaaaagaaagaagtggcttaagttggaaacttatacgttacgtgatggtttaacagtacctaaaattggctttggaacatataaactgaatggtgctcatggtgtgcaagtgatcgactcagcgattgatcgcggctaccgattattagatacggcctttaactatgaaaatgaaggtgctgttggtgaagcggttcggcgttcgtcagtaccgcgttcggaactcttgatttcatcaaaacttcctggtcgccaccacacctacacggaagctatcaatacgattcaagaatcattatatcgagctggcctggattattatgatttatatctaattcattggcctaaccctaaggaagatcattatgttgaagcttggcaggcactgattgatgcccagaagttaggcttgattcgttcgattggggtctcgaatttcttaccagaacatttagaacgattaaacaaagaaacgggtgttttacccgtcattaatcaggtcgaattacatccgtactttaaccagcaggcacaacgggattatgatcaagcacacggtattttgacgcaagattggagtccccttggccgggccagtgagatgcttcaaaatgagacgctcaaagagattgcagtgcactaccataaaaatgttggtcagttgattttacggtgggaactacagttagggaccttgccgattccaaagtcgtcaacgccgagccgtcaagcaggtaatatggacgtgtttgattttgaaatcagtgcagctgatatggcaacaattaatggtttgagccaagtggatggtcgcttgaataatcaagatccagcagtgtaccaagaattttaatttgaatgatataaaaagatagcgacgttgtgatgataactcgtcgctatctttttatgggcaactgcttgttgatgattggtttgtgatatcagcgtaatcgcaatgcatggtgcagtagcgattggcttttttaatcataaaaaatgctaactgtgtagctgtgagccactatctggtaaaatatgtttataggtatgttttaagggcgattggctgttttcatcttgaaaggtcgtggtagtatgacaaatacgtttcccacactaggaaaggttttcagccgtggtcactctacctgttcggtttgctttcttgcaaatcattttgagcatcgcactagcgatgtatcaggtatggaactccagaaacaaaaaatagccaccccaaaactttggccggtattgggtgactgttctttgattatctaaatttaaagccaactgctcttagagcgggccttgattcaagtcggtattaacgtaccggcttttttactgcctttattttaacacgtatgcgcttcagaaagtgtatttttgattcaaaaaaataaagataagcttccaatcgattggcataactattttattacgcgcgcttaaccgcgattaccttaacttgataagccccgttcggtgcgttcacagtgaccacatcgtcaacagtatgattagcgagcgcttgaccgatgggagatgtgaatgagattttttgttgttcgagattggcttcctgttttccaactaattgataggtgatttggtcatgatcatccagaaattcgatggtcacgaatttaccgatatcgagttgattgttgtcagctggttgaacgatttgggcgtattgcaactgcttgttgagataacgcaggcggctttctaagcgacctaagtcccgtttggcactactatattcggcattctcagaacggtcacctagtgccgcagccgcagccagaattctgatttgctcgggccgttgttgctttaagtcttcaatttcctgttcgatggcatggtaaccagtcgcagtcattttgttaaaagttggttccatagcaaaaacctcgtgtccgttgaatttctgggaatagtttaccgcaaatgtgattagaatggtaccgtctaggtgatatctgatgttaatcacgatcgcgcaggtggttgctatacagcatgataccgctagtgacggtggtcagggcgataccagcgatcagactaatgaacggctgatttatcgcaatcaggaagtagaatagggcggtgaaaccgattagttcaatgagtgcccacaggccaaggtagcgccatgaccgtttgggtttgtcttctattggggtgctgacattaacagacaaaatgatcatggtaaaaacggcaatcatcaggacaatatacaacggattgtcgtacgtaaaggctttctgaagattgtttttttgccagccttgccaaaataaaatcagtaagatagcactattttcaattaacaacgtggtacggatgttcttgaaattttgtaaaattaaacgttcgtcacgaatctttttcatggcagggatctcctaactgggttcgacccaaaagacagtatcgagtgtttggttgagtgcgtgacagaggttgaggcagagtttcagtgatgggttataggtgcccttttcaatcaaactcagggtttgacgggtgatgccagtcttgctggcgagttctttttgtgagaatccggccattaaccggtattgcttgacatgattcgcggttaacatctccctttatgtaatatatatcttccatacaaagctaattttagcagttaccaattgcaatgtaaatgttggatagtttgattgaaatgtgaacaaataaatggttggcgtagaggtatgagcgcaaaaaaatagccaatgactttgcagccttggctagtcgtggaatttctcacgttccacggagttacgaacatgttaagtataggcaaaattatcgaaaaatacaattaatttattaaaggagtttggcttgacagtttaacaatgataacgattgcaaaaagtaaaagtgaaatatttcagacaaacctcttgaattttagtctagaccaatatacaattggactataccaaacaaagagggagtcagttaattatgaaagttatcgtagtaaaggatcaagctgccggcggaaaagaaggtttcaaagtatttaagaatgctttagacaatggtgcgaaagtatttgggttggcaactggttcgacacccgttacaacttacaaagaaatcgttaatagtgacttagatttcagtgactgcacatccgttaacttggatgaatacgttgggattgcaccagacaacgaccaaagttataaatacttcatgcaaactcatttattcaatgacaagccatttaaggaatcattcttgccaaacggtttagcttcagatccagaagctgaagttaagcgttacgacaaagtgattgacgaacacccaattgacttacaaatcttagggattggccgtaatggtcacattggttttaacgaaccaggtactcctcgcgatattacgacgcacgtggttgatttaactgaatcaacgattgaagctaacgcgcggttcttcgccagcgaaaatgatgttcctaagcaagccttctcaatgggcttagcttccatcatgaagagcaagcacttattgctcgaagcattcggcgaaaacaaggctgatgcggtcaagggtatgattgaaggcccagatacccctgaattaccagcaagtatcttgcaaaaccatccagacgttaccgttatcattgacgaagcggctgctagcaagttaagcaagaagtattaattttaattaagttaaaaatgaactgaaagccgtgcttcataacgattgcgttgtgaaacacggctttttaattgtgtcggtcaagtcggtcaagtcggttattgtgccgccgttactaattttttctggaactgaaatcccatacatagtacacctaggatcagcgcaataacgccgctgactacgaagacgttaatactcataccagcaactaatttagtcaatggattaacgatgaaaggactgaccacacccccgattgagtaaatcgcgacgtacacacctagggccatcgaaacactgtttttgccaactgaaattgagatcaaatatggaaattgtcccatggcgatactcattgcggcacccacgatgaagctacctacaaaggctaaccatagcgaatgtccaagaccgattaacaggtaggacaggccgtataagataaacgagattgtgatggatgagtatttgaaccgcttgccgataacgccaacaatcaagccgcatagcatccccccaattaatgaaacggttgacgttagagcggcttgtgaggttgcgccaagtttttcttcagcaacaaatagtgaaatgttgttgttcaaaacattatttaagagtaacgtgcagaatccccagaaggcacagaaaaagacgtatttgttgagcttaatttgttcaccggtatcctgatcgttggctgcattgactgctgccggatgcatcggcactaatgttaagatcacaatcaaaataagtgctgagaataagtaaatccaataattatttacccaaccgttcgttgcagctagctggccgccacccatgatgaagacaataccaccgagattggtgaaggtggttgttaaacccatagtggactggcgttcggtttctggtagcatttgagaaattaagacttgtgataaattggtgcaggcgccttgacctagaccgactaagcacgagcaaaataacaaaaacatgaagtttgtgtggaaggctaatggtagaaaaccaccgataattactaagattgccgcactaagggttaatgttttgagattgagcttggttgccgttagtttgccaataatcaaccctgctaacatcataaatagattaggcaatgatgttaacatctggacactcgtattactgagtgaaaaattggatgcgattgctgcataggatggggtaattgcgagtgccgccatgcccattgaactgactgcaagaaccccaatccgggtcttagaaacgtagcttttacctggtcccgatatcgattttgttgtttccatgctggacatccccctaaataaaagactcaatattggatttatgatttagttgacagtggcgaactttgctttgacgtaagccgcggcacttgttcctgcaattcggcccgacgtccaagtaaagccagaggcaaggccttcaaatgcaggatagctgtgtccctcatagtaaccaccagcattggcgccaccagtataaagaccgggaataggtttgaaatcgtcatctaaaacggcgagatttcgattgacccgaacaccaccgaccgtaccaagataggcggcttggcagatgaaggcgtagaagggaccatcactaattgaataatccaaggactgcaagcgcttactgaattcgctgtcgtttttggacgcgacagcttgattataagtagcgacggtctggctcaatgttgaaggatccataccagcattagtggctagctcagtgagtgagttccccttaaaagctgttttaccagtgacagcttcttcagctaatgcggtaaagtcaccactgccagtcgctgcgcccggtcctgcttgagaaacttcttcgcgattgcggttggtggtgaatgtattgagcgtggcctgatccacgataaagagatattgaccaccctgagaccaagcagcgttcgcccattcaacggtatcgtagaccacatcttcgttggtgaatcgttgtccctgcatgttgacccatagttgaggggttaataataattgggttaatggattaccggaaaaaccagcaaggtgttgctgagaagtcttttgagtgacttgggatttagctagttgcgcagcatgaatgagcgcatggctgtcgatgtcagtaccgccagctttaaccatagcagccagaccttcaccgttatttggaacacctaaggttcttagctgcgtggtgtgcatggttcgagcaactttttcacgatcaccaccgtacccaccggttgccacaacgactgcgtgggcggtgattgttagctggtcacctgaagcggtcatggctgttgcgccagtgactgctccgttggtaattaccaggtcagtaaaggtcgtattaaagtgaaaattgacaccggcagtcgttaatgtttgttggatgcgctgatagctctcgtctttatgttggtacatatgataggaacccccacgataatcattattacgatgcgcaaactgagtcgtattggcagttgggttgagtttgatttccattcccattttttccaaccaggctaaggtatctgccgagcggttaacgatccgcgcaagtagggtaccattggacaaatagtgattgtagtcggctaattgtgtaatggcctcctgagttgttaggtgcataccggcttcccgttgttcacggctattaatggcgaaaaatccacttgagatttttgtgttaccgccaatttgtgattgcttttcaataacggtgactttaagtccatgggtcacggctgcgtatgcagcggctagtcctgtaccacctgtgcctgcaatgaggacatcagtatcaattgttcgattagtcataatagttgcactcccttattcgaatttacaaagttagtataaagctaaaatatgcacaagttgatagtgtataatatccttattaatatgtttatatatcttttaagggattgacaggtgatagtgatggcttctataaatacggtaaatagcaattatcaattgaaagaaagcgattttattggtctacgccgtaatgatctttcaagttcaccaaattgcagttcagagtttcacattcgctttatcgtgagccacgatttcgctgaattaacattagccggaaagtacgtggcactgtccccagatgatattgtaatggtttcatctgcgcagccaattaatattattaataggggggcaccagtaaagttaagtgttttttcggaacgtctgcatgcgcctacgccattaaacttggtggttgtcggagataacccaatggttcatgatttaatgaatgcgggtgagcggacattgcggtttattgtttatcgccaattgcgaaatcagataacccaacggtactttgatttgttgacggagttagaacggcaagatttgcaagatgtttttattgattatcaacgagaaatgacggtgggattgttaatgacggaactattgcggcatcatgaggaacgcatctcgattacggattcttattttcctggtaaaaatattcgacatgttaatgctgatacgcaatcagggatgatttttacgtatttagtcgcacataacgcagatgcgacgttaaaagaaacggcatgttactttggatatgataaaaattatttttcaaggctgtgtcgacgactgttcaacaagagcttttcggaacaattaacatttattcgtattgaactggccaaacgaatgctggcattttctaataagcgaattgaacaaattgcagctgaattaggctataaaaataatagtagtttctttactgcgttcaaacgcgaagtggcgataactcccaatgattatcgtgagcagcatgggtatcggttagcacatcagcatatcaatgataattaaaaacacaaaacggcgtgctactgaaatgttccagtagcacgtcgttgatgatttttttatagattttgtcctttttcccaagtcgttttcgataacaacagcccttgcttaaccaaagtatcaaacaacgcatgggtccggttggaaatttcggcggcggtttcgctattggctttggtcaagaaatcggtcggattgccggtaatggctgcgtcggttgcggcaacccggccacgggcatatgattggcacccgtcgcgataggcattgaccgtttcagaaaattcatgccagtgtggttcaatcaagacggagagcgtttttgataaccagtagacgttatcaacgctgaccgtgctagttgtattgcgataatcaatcggcgtgtcattgatgttggtaaagaagggcacgtatggggcgtaagcgaagaaacctagtgcgatccattgaatggcggcttgcttagcaggcacgtcattccggatttgcagaatagatgagcactgattgcgatccatcgcgatagaccggtaacgtgtttgttcacgggcgttaccggaagcgaaagtgccaaatggatcgtaaggcgtcccgttatagtgtgaagataagaagaactggacgtcttcaatagccaattttttgcttggttgtcggaatagcggcatgttttgatcagtgggattctgttcgatttcgggattaaatagtttttgaccataccatgttcgcggagtgttgtaataagcatccgcctcactttgggtaccaaagatttcacggaaattaaagtgaccgggtgttgggttgaggtgatacttttcaacgaagtccactaaatcactggcacctaggaaattgtcggtatcgttgagatccatctcttgcaccacggtttggttgggaacaattgcgtaggtgtcttcgggcatccgaactgccccccaatggtgaccaccagcggtttcgaacaaccagatatcgtcgtgatcgttaaaggcgatactgttgctttcaccagttccgtatttttcaattagggcacctaagcgttggacaccttccttagcacttttaatgtagggtaaaacgagggtgactatggcttcttcatctacgccatcatggacgagcggatcataaccgagtacgcgggcattggtggcagtggtttcagttgcgctcatcccgacatttaattcgttgatcccagcttcctcgtactgcccatcgctttgatcggcttggggggttgcggtgtagcggtaggcatggtcaggcagcggaacggtgacgccggtagttacggaagtgtagctggcgttagtttggtcgtgggcttcgtgcacaataaacttaatcggattaattgggccgtagccatcttcgttgcgggcaacgatggtcgaaccatccatgctagcagctttcccaaccaatatttcggtacaatcagtgtcttttttcattacataggtcactccttagttaattataagtataggagcttgcggggggatttcaacgttaaatcgtattcgtaatcatttaaataataaaatgatgagagaattgccaggtgttttctgcataaaatgttgaatttgattgtgaaaattaaatcatagctgacgaagaaagtttaattagtctgctggtattgccgatataaaaatttttatcgatactgtgccaaattttaactttgtgaattagtgagtttaattgtggcacagtttcctgtgccacgggtctaactagaagttcttgaaaccgcttaccccgatggatatgattaagttgttaagaaaaaggaaggagctttacctaatgagtgaaaatgtaaatacgaatgcaacccaaagcgctcctgttgcgaaaaagaaactgggcgttaaggcacgcgttcaaaaatttgggagtgcactaagtaatatggttatgccgaacatcggcgccttcattgcttggggcttaattaccgccatctttatggctggtggttggtggcctaatgctggattagctaagatgattcaaccaatggtccattatttattgccattattgatagcgtttactggtgggactttgtttgccggtcatcgtggtggggtcgttggtgcgattgccactatgggggtcatcgttggttcttcaatcccaatgtttatcggtgccatgattatggggcctttaggcggttggtgcattaagaagtgggatgacgccatttccgataagattaagagcgggtttgaaatgttggttaacaacttctccgctgggattatcgggatgttactagcaatcctgggttactttgcaatcggcccattggttgctggtgcaagtgctgctatggctgccggtgttgactggatcattaagatgaagctattgccattagccaacgtcttcattgaaccagccaagattttattcttaaacaatgcgattaaccaaggtatcttaacaccgcttgggattcaggctgcatctagtgcgggtaagtcaattctgttcttgctcgaaccagatccaggtccaggtcttggggtcttattagcctttgccttgtttggtaaagggactgctaaggcttctgcacccagtgcgattattattcattttcttggtgggattcatgaaatttatttcccatacgtattaatgaagccagcattgttcctagctgttatcgctggtggggttactgggacagccacattcagtttactaaacgttggtttacgttcaacaccttcacctggttccattatttcattactattaatgtcaccaaagagtatttctaactacattggtttaattatcggggtaacgttagcaaccttagcatcatttatcgttgccgcaattgtcttgaaacgtgacaagtcgaccagtgatgatgacttagccgctgctcaaggtaaaatgagcgatatgaagagtggcaatgctgaagctgctagtgcgactgacgctgaaccagctgatgtgattgcttcatacaaagatgttgaccatattatttttgcctgtgatgccggaatgggatcatccgcaatgggggcttccttattacgggataaagtcaagaaggctggcattagcatgtccgtcaccaacacggcgattagcaatttgaaagacgaacctggtttattagtgattacgcaaaacgaattagctgatcgggcggctcaaaaggcaccacacgccttacggttagccgttgacaacttcttgagtagtccaaagtatgaccaagttgtggttaacttaaaggctcgtgatcaagttagcgatgctgcacctgcatccgcggcaccacaagcaacgacggctgcacccgacgacctaccagctaacttagatttgagtgttgttgatgaaattgtctttgttcaccacgatggtcatttaggaacagccacaatggcaacgtccttgatgaaggatcgggtcaagaaagccaacaagcatgtgagtgttaagaacttaggaattgacgaattggctgataataatagtttattagttgtttcaagtgcagaagcagctaaaaacttaaagacccgttacacgcaggtccaagtattaattactgacgatctattgagttcacctaaatatgataagatggtatcagaattgaaataaaatgatattattaccattatcgtatgaggtggcatcatggttaagtttacacaacgtcaagatgagttgctacagctgctactagcgaatcccgccggcctttcaatgagtcagattgaaaccggtctcaacagtagtcgccgaacaatttatcgcgagttcagtaatttggaattggtattagccaatgctgatttgaaaattgttaatgagaagcatcactttcaactaagtggatcgcagacggccctggccaagtttcaaagccaattgacagcagagcggaagattgcaccggcgtttgactcacaaacgcggcaaaacgccctagcttgtcggttactgatgacgggccattccgtaaaattaaaagaacttgcgcttgactttgatgtgagcgttgcaacgatttcaaacgatttgacggcattagcaacgccattcgccgactacgacttatcaattgaacggttgaagtcccgggggattcaggtggcggggactgagggtagtattcgcaatctgtttgccaccattttgaataatgaaatcaacgactacgagttttttaaaacaatcgggaagttgaaccaaggcttagcaatatcagcaagtgatgagcaatcgtattttttgaacttactggacgcccaaacgttgattatctgttatcaagcagtgcgaagtttgaagaaaaagtacttttcttcggtgccggatggtcagctacaacagttgatcatcacgttgacgacgggagtaatgcgtttacagcatgaacgtcgggtcacatatttgcgcgggatcaatcgggatgatttcttgaaatatcaacggattgctctggcaattatgacccaactacccgctgagattaagacggtggtgacgggagctgaaattgattttctcgcccagcaaattaagggcttgacgtttcgaatcgatcaagacgcgtcgctatcgaattatgatttgcaactaacgtatcgggtcaaaaagtttattgacgcggttgcgactaactttaactggtcgtttgggacggatgaccgcttgttgaataacttgacggcacatatgcaaattgccctacaacgtaacggtgttaatggtcccgtgccgccaaccactgagttacaagaggtccgtgaacagtatcctaagctgtattcggcggtggtgcgcggcttcgcaacgatttttaaagaccaggattttacaactgatgagttgacgtacttgttgattcactttgctagtacgtatgagcaacagttgagtcaccaagcactcaaggttttggtcctgtgcccgaatgggatgacgacggcgcgaattttgaaaacgcgactgatgcggttagtacctgaaatcacggctatcgaggttgcgcggattggtaatttaggccaagttaatttacaagactttgacatgattttatccacgacaacgttaccgggatttaagttgaattaccgcgttgtcagcccactgttactagaaaacgaagtcactgccttacgggaatatattcatcagtattttccaagcaccaaagtgatcgattcaccggttgatgagccgacgaaaatcaacttggattttgacaccgtttaccaacagatgacgattgctaaacagatcttagaccgtttcactatcacgccgattcgcaacgatgatgagacggtggccgagatgctagttaagatcacgcggcatattgattcgaacttgattcatgatccgctagaagttgcgggccggttgttacaccgcttaggactggcgccggtcggtattcccaatacgaacttggcgttggtgcatacgttaagtcaggaagtcactgcaccatattgtgcgattttcgaacttgaccagccattaccatttaagagtatggacaaccaatcgattcggttgcagcgaatcgtcctaatgctcgggcccgccaatatcagcgattttgaaaatcggttgatgggtaagttaagcgcactagtcattgaaagtcaggccaatacgcagacgtttatgactggcgatcgccagcaactttatcaattaattagtaaagcatttttgaacgaactaacgaaatagcgtaggtgaaaacaatggaagctttagataagaaaatgattgcgttgaaccagcaagtggctacgcaagaagaaggcatccgcttagccggtcaactattggtcgatggcggttgtgtcgaaccagaatacattgatgcaatgcaggctcgtaatcaggatgtctccgtatatatgggtaatttcattgccatcccccatggtactgaagatggcatgaagtatattaaaaagaccgggatttccgtggtccaagtaccaatgggtgtgagctggggtaatccagatgataacgatgatgataagactgtaacggttatcttcgggatcgctgggttgaacggtgaacacttgaacctcttgtctcagattgccatatactgcagcgacgttgccaacgttgctaagttagcggacgctcaatctgaagatgaaatcataaatctattaaaggaagttgattagcatgttagacgtacattttggcgcagggaatattggtcggggcttcattagcgaaaccttggctgacaacgggtttaagattactttcgttgatgttaacgatactttgattgacgaattaaacaaacggaatggttataccattgaattggctgcagaaggtcaaaaacatattgaagttcacgatgttaagggtattaacaacggtaaggatcctaaggcggttgctgaagaaattgcccaagccgatatggttacgactgcgattggacctaagatcttgaagttcatcgcgccattaattgctgacgggttaaagttacggcaagctaacaacaatacgacaccaattgatatcattgcttgtgaaaacatgattggcgggagtcagtcattaaagaaatccgtttatgaatcattaaatgaagacgaacaagcttgggctgaccaaaatgcgggcttccctaatgccgctgttgaccggatcgtaccgcttcaaaagcatgatgatccattgttcgtttcagttgaaccattcaaggaatgggttatcgacaagtcccagatgaaaaaccctaagattcaattaaagggtgttgattatgctgacgacttggaaccatacattgaacggaaactcttctccgttaatactggtcatgccaccgtagcctatactggtaacatgaagggctacaagacgattggcgaagcggtcaaggatgacagtgttgttgaccaagctaagcacgttttaggtgaaaccggcgacttgttgattcaaaagtggggctttgatcctgaagtacaccatgcttatcaaaagaagattttgagtcggtttgaaaacccatatatctctgatgatattgaacgggtcggccggacaccaattcggaaattaggtttcaacgaacgtttcattcgcccaattcgggaattgaaggaacgtggtcgcgattacagcgccttagttgatacagttggtgaaatgtttttcttcaactatcctaatgatagtgaaagtgttaagttacaacaattattgaaggatgaaccaatcgaacaagtcattcgcgaaacaactgacttgaaagatgaagatttagttaatgaaatcaaagctgcgtacgaaaagcacttagctgcaacaaagtagttcgataaaaaaactaattactaaccgccatggtaattagctgcaaaaggcgcccagaaatttaattctgggcgccttttgcgtcttgcctgacaaagaaccacttgatagcagccatcgctgggcgagttaactggaacgatgaacgtgtaggtagcttatttttaagactggcagcacacgttaatttggatggtaggtaatgcttgccctaccgaagtaagtctgatgagcaagtatgttgaccagcatatggctacttttcccagaaatgccaccaaggtttggccgcttgactggcttgttgatcaagttggtcaaggacttggtttaagcggtcactgagtgaatctaagcgccggatgatcatttcttgctgcttatagagctcagcattagtcgggccatctggcttggccgctggtgccattttgctgggatcgacggtggttgtcgtgatgaggggcgacttggtggtagttgcaggcgctgatttctcagactgagtcgtcgttgccgccggttgtttggatgtcgggaccttagcaccaaacgcccgtcctagcgcagtggctaacgttgtgccctgttcggcgagttcgatggccgcctgaaaagtttttaaatcagcggctgtatataagcgatgactgttatcggccgggcggaagcgattttcatcgttaagctgtttttcaaccatggtgctatatttgcgcaacgtcacggctttaataccgagttgttcagcggcgacggaagcgactaattcggagtcctgttcgggactgattgtttgtgtggacacaaaaattcctcctttaggttatatcgtttctataacgctattatatcgaatttttgattggtagaacaccgatataccaagattttgtgacctatgtacgtgattcagacccggaagtcataattttgtgggaaaacatgctatgatagaacgaaaatcaattggaaatgaggattagatatgatcgaaccagtcgataagacgacttttgcgacggtggctgatggtaccgcgttaactgtggttgatttttgggcggattggtgtggcccttgcaagatgcaggaaccagtgcttgaagcgttagatgaactgtacgatgggcaagtgaaatttgcttcgctcgacgttgatcaacatcaggaaattgcgcaacaatttgagattatgagtattccggcgttagtgatattcaagaatggccagcccgctgaaaaggtggttggttttcatccccaagcagcattgaagaaatatctggatcaaaaactagccgaagtgaagcctgcctaacgagcgttatttaacggtagctgttgaagcaatcaataagtccccccagaaacggttaccgcatctgggggacttatttttcttggtgagtaatttacgcgttatgacgtaattgataagctgcccatgtgctgaaaatggcaatgccaagaattgcgaggttaatgagaatcgtttctgtcagtggctgggttgatggggagaaataccattgttctagtaaaaaagtgtacaaaaacacgggtgcgtagaagaagcggagccatcgttgctggcggtgtaaccacaccagcgtaattcccgacaaccatatcagtactgatataacaaccgttgtcagtggactaactagcatcgtcagtgtggcgattatggctagcagatagggtgttgtcataagtgggttcttgaatgagttcatcagtagtgccttcttattgaaaaagctaatgctcgtctaagtatatcgcgataatcaaagtgtttgtattgccatcataaaataaaatatttaaatagtgattttgacaataaatcagtttagctgtcaagttagaaatcgttaatagtttaaggggaagcgcaactagaaatggcgagttggtgcgactgccctattaataattaaattattaccggctttgccaatataattagctaagaccatgttaaattaagtagcgtaattatggtaaagtgggggctaatcattgaaaaaattgatttgggaattacgggtcggtatcgtcctctttggtgcttgtttggtgtgggaacaagtgcagcttgaacggcatacaagccagcgccggacctatcatcaacgtcggctgcagcgtagtaccgcagcaacgtttaaggcaatccgtcagccacaacttagtgattttccggcagctaaggtggaagccgcacaagtttggctacacctgaaggggactcaggtcatcaacgaggcaaccccgttacatatccgcaaaattgcggccggacagcgaattcagccagacgatccgcacagcgcggtctatcatcaccaaatgacccagatttatagtgatgatttacaagatgctactaatagtgtgatatacgcgcggaatgcggataatactgtattggttgcgcatagtcgttcgaggcaacgctcgcaagtgggtccggttgcccaaaatgttcacacagcaatgccagccgttcaaaagatgaagattccggctaaaccatccgcgacactgcttaaagtcgttcaactgatcatttaatatggggcaatttaaaaggctaacccacacggtgggttagcctttggtgcgtgatgctggccagctaatagtggtcatagagttgctcaattaagtcatcactattggtaatgagctggcgatttagtgaaatcagatagtctggttgtgctgggtgaacggcgttgtagagcgtgtcttcaatgagacagccagtcagcgtgaacgaccgctgccgaccttgaacaatgatggtgaaggaacgtccacgactagttacgatgacattcaatcccattaagtgggttaggttcaaacctaacgttgcagttgaatcaattaatcctggtgtgccagtacgtttaatcaagactaggcattcatcaattcgtcgtagcgaattaaacatcgaaaatttactggtgttgcgcgggtccgatttgacagcccgcggccgccgtacatatggtccaacgactatgtgcataatgattcccccaaaccatttagttgattggtttaatcataactagtgcgaacgattagtgcgaaaatttcggcgcgtgttggcagttagtggggccagtttacgggttatctttggaagctttactaacgttgtgacggaaaacatccagtgtatacaaattcgcaattactggacgcaatggcgttcagaccattgatcagtaattgcgaattgagtaatcgtgatgttaaaaatgaagctaggcttttactttgttgtctgcttttcgtgctttgacagctaattcgggaaaccaaattgcaatttcgtgatgcgcattttcacggctatctgaggtatggataatatttcgtaaaataccgtctggatattcatgagagaaatccccccgaattgtgccaggttgtgcttcggcaggccgggtgctaccagctaaacgatgcaccgctttgacgacgccagtaccacttacgataatggcgacgagtggaccttccatcatgtaggtctcgatttccttaaagtaaggcttgccaaccttctcactgtaatgttgttgaagttgctccgcggttgctttaataacctttaaggcggcaatttgataacccttgcgttctaaccgggtgataacctcaccaatgtgtccttcactgacaccatcgggtttaactaggaccaatgttttttcagaatttgccataatacgtgacctcctcgctttttgaaagcggtatcatttataacttaaattgtaggtgactttgaggggtacgtcaactagaatcgccgttttatcatgaaaattgcttgtaaattggcgtcagctggtcaataattgggacgcgagaagcgggctcaactagctgaattattttctatcgttggaagatatcgctataataaaattagtaaatcataaaaggatttgatactcatgccaccacttgatttaactcatattcgacaacatcatacggttgctgaattaattgcgctaggaaaggcgcggcgccaagtcaccccatttgaaaaattagggacatttacaccggtgaagcgaaacgccagtgattatctgaaacatgtgcgggagatgctggtaccagaactattaccattgcggcgtgaacgaatgtccgcttcggcttttgcattcttccggggatcagtggagttaatggattacgatttggattatcagtcgtccactgaaatttccgccgtagtttgtggcgatgcccatattggtaactttgggttctatgcgtcaccagaacggcgactggtatttgacttaaatgactttgacgaagctggcgtccatccgtgggaatgggatttacgtcggttattagttagtgtgttgctagctgctcgtgattctaactttaaaccaaaaaaggtcgaaaaattgatacaggcggcgagtgcgagttatcgggaagcactcaaacggatgtttgatcagacgacgttagaccgtttttatcgcgataacgaagttcaggctgtcttgaacttcggtggtgctcccgaagatacggccgatttaattgcatctttggttaaaaaggctcaaaaacgtaattcagaacaagttgtgcgtaagtttacggtcactaatagtcgcggtgaacggcaatttaaggagaacgcgccccgttctgtccatattgatcggcaaacttatcaagggctaaaggccggaattagcgagtatttattgaacgtacggaccgatgtcgctttgctgttgtcgcaatatgaagttactgatattattcggcatagtgtgggcgtcgggagttttgggtcactatgttacttggttcttctgacaagtacggatggtagccatatggtgttacaaatcaaggaagctttaccaacgcggaaagtcgggagccagtcgcggccagcgttaacggccgccatggaattgacggaagggcaacggatcgtcagttcgcaacgcattttacaagcaacctcggatgcgttcctaggctatttccaaatggaaaataagagtttttatgttcgtcaatttcgggatatgaaggaatccatcgatattccaaccctagactggggtcaattccaagcctatgcaaatacgtgcgcaatgattttggcaaaggctcatgcgcaaagtccaacggcggccatgattcggggatacgttggtaattcggcgaagtttgatgaagccatggctaaatgggccacggcgtatgttgaacaagttgataatgattatcaagatttcttagatgtttgatggtttaaacgaagagttgatcaaatatcgcactgaaacgcgtgatgattagacgtgtattgaaaataaagaaagggtcatcggaatcattgatactccgatgaccttttctgtcggtaattagacatagactaaaatatttttctggagcgtaagtcttgatttaacaacgttttttggcgattgaacaagtgattttgaaaattgataggctaaaatggttgcactttttcaacaacttgatatacttactattagtaagtgaaacgaagaaattagttttgaaaggattgtttgatatgacaaaatatggtgtaattgtaggttctattcgtaaaaattcttattctaaaggggtcgctgaagccatcgttgctgggttaccagacgacgctgaagtaacgtacttaaatatcgctaagttgccactatataaccaagactacgatgcggattcacccgtagaatatacagaatttcgtcaggccgttgcggctcaagatgcgttcatctttgtcacacctgaacataaccgtagtatcccagcagccttgaagaatgctttggacgttgcttcacgtccatggggtcaaagtgtttggggcggcaagcctgctttggttgcttcccaatcgatctctggtatctctggcgtcttagcacaccatgttttacgtcaatccttggtcttcttagacatgccaacgatgcaacaaccagaattgtacatcggtaatactgataagttggctgatgaaaatggtcatatcacaaatgaaggcacccaatcattcttagctggtgctggtaagcaattcagcgaatttgcagcgaagtttgtcaaataattgtggataataaataaattttcaaagtaacgtaaaaacgtacttataaaatcaattttgattttataagtacgttttattgtcgacacaataactgatacgagcaaacggttattctaagccgcagttttgataagaatcaagcttgattgctggttgtttcatgataagcatgcaattgagtggcaactagatgggccgggttaccgaccgcagtaacgtgggcgggaacgctatctaaaacaatcgcaccagcaccaattttactgttggcgccaatcgtaatagggcccaagagttgggcgtgggcaccaatgaaagcaccgcgacaaacatagggatgccggcgcccagattgttcggttttacgtgcgcctaaagtgacgccgtgtaaaattgtaacgtcgtcttcaatgaccgccgttgcaccaatgacagtaccaataccatggtcaaagaagacccggtgaccaatttgcgcggccgggtgaatcagaatcccggtacgccgggccgcatgttggctcagcaaggcggccaataatggtaaacggtgtgtttcaaaataatgggcaacccggtaccaggcgagcgcgtgaataccaggataggtcaacataactgtccgcaaattgatcgcggcggggtcacgattgagaatggcacgagccgtctgaaacaccagcttaatctgcctgaatgctagcgaacccgcgctcaaggtctgctaacaaatcgtcactggcttcaacaccgactgataagcgaatcagctcgtctttgatgccattctgtagccgaattgtgcgtgggatggcaccgtgagtcattaaggctggaatttcaattaaactttccaatgctccgagactttcggcgagcgtgatgacttgtaaatgttcaacgaaggtctgggggttcattcctggttgtaattcaaacgagatcattgcgccgaagccattcatctgttgcttggcaatcgaaaaatcgggattatcaggatcgcctggatagtaaatcttagcaactgctgggtgagactttaagtaagtaaagattttagcggcattattcaggtgggcttgcatgcgcaatgccagagtcttcataccacgttgtaatagccagctttcttgcggggccaaaatactaccgatggcattttgcaagtagccgattttttcgccaagtgctggcgtcttggtgacaaccaagccaccgataacatcactgtgaccaccgagatacttggaagcactgtgtaaaacaatgtcaacgcctaaatccaggggcttctggacgtatggggaggcgaaggtgttgtcgatgatactcagtaaatcgtgtgcttgcgcgagcttcgcaatggcagcaatatccgtaatgtgtaataacgggttcgtcggtgtttccaaataaatcgccttagttgtgggggtaattgcggcttcaacggcggccaagtcacgcgtatctacggctgtaaaagtcatgccaaagtgtttcaaaacggcgtcgatcaagcggaaggtgccaccgtagatatcatttcccacaataatgtgatcaccagccgagaatagtgagaagacggtattaatggcagcggagccagaagcaaatgcgaagccagcgctgccatgttcgagggtggcaattaatgcttcgacggcggcccgggttggatttcccgtccgtgaatattcgtattgattttgaccgatttttgtttggcggaaggtcgaggccatgtagatgggtaccgaagtcgcgccagtagtggcgtcctcactgataccaccgtgaattaattgggtttcaaatttcattgttaaagtcctcatctcgtatagattttttggctcagataacgctcactactgtctggaaagatggtcacgatatgactattggcaggcaggttggtggcaagttgtaaactagcggctagcgcagcgccgctagaactgccaatcagtaaaccgtggtcacgggctaggtgtcgaacttgggcaaaggcatcatcgtccgcgatggtcagtgtctgatcgatgcgaacctgatcgaaaaatggtgggatgaattcgacgccgattccctcagtacgatgtgcgtgagccggtccaccatttaaaatggaaccttctggctcaacgactacggctttggttgctgaatcttgggcttgaagataagccgctactccggcaaatgtcccaccgctaccggctccggcgacgaaggcggttataggtgcaggcatgtccgccagaatttctggtgccagtgtgtggtaataagccgcgggattagccggattcttgaattgcatggggacgtaactgttggaaatcgttgcggctagtgcctcagctttgcgaatggcacctttgattccttcctcgctaggtgtatgaacaatttcagcacccaatgcttgcattaaaacttgtttttccatactgaacttttctgggacgactaagatggtacgtaggtggtgcgcttgagttgctaaggctaaaccaattccggtgttaccagcagttggttcaataatcgttgtcttggcgttaacccagccccgttgcaagccgtcttcaatcagataggctcccagccggtccttaatactgccgccggggttgaacatttcaagcttggcatagatgtgactgtgatttggaacctcgatgggtaacgccatcaggggggtgtggccgataagttcttgaacgtgctgaatgagcatataaattcctccaatcgctgcggtggggtgccaaaagcgacaaaaaaggcgcgagaattcgaatgaattcctcgcgcccagtacaatatccagccatgctggacattgatttttaggatgacactcctcaaaaagtcaatgcttaacaggccgaacatcgcgataagcgcgcagttcggcaacaacagttattcaaagcactacttgttaattgagtcatgtctgatcctcctctggattaattgggactaactatacaagatgattttgagcgcgtcaagtggtgaatgacgatttgcaataagcggtaaaagatgaagattggctgagaacgttattgaatcagcgttagttttgccaaacggttgtcattaaaataaatatattaggtggttgaatcagttgattgtgaccgaggataaagatgttaaaatttatccaatatcagtttttcatgtcttataatcaagacgttttccaagacacatataactagttttattctgacaatagctagtgaacgtgctgttgataataactaaaacaatcccaccctgattagcaagtgactaaactagggtgggattgttcgtgattataatttaaatgatattacttattccataagtatttagcatcaaaatcattatcgaatgatgataaaatcttaggaccgtcatcggtaacgacaagggtgtgctcgtattggcagctaagactgccatctaaagtgcgaacagtccaaccgtcatcggcagtttcgccagaacgccagtcaccaatattgaccattggttcgatagtaatggtcataccagcttttagacgggtgccgtgaccagcttcgccataatgtggaacatcaggcttttcgtgcatcgtcggtccaataccatgaccaatgtattcgcgtacaacgccgtaacccatttcgttttcagcgtaattctgaatagcccagccgatatcaccaattcggttgccaacaacggcttggtcaataccgaggtatagcgctttatgggtcacttccatgagttttttaacttcgggtgatggtgtaccagcaacaaaggcgtggcaagagtcactaaggtagccatggtagttaataacggtatcaacttttaataagtctccatctttgaccaagatatctttactaggacagccgtgacaaatcatgtcattgacgctgacacaagttgagtacttataaccttcaaagttgagttcgccaggagtagcgtcgtgtgcaacgatgtattcgtaggcaaagtggtcaacatcccaagtcgtaattccgggcttgatgtagtcttcaagggcgtgaaacaggccaaccatgatgtcaccggcagcttgcatccctttgatttcgcgatctgatttaagcgtaatcatgaggttcctccaaaaaaattaattatattgtgatgctaaaagtttgttcctctccagtatactgcaagcattgtattgcgacaaaacgcattgttttgacctgatattgacaacgctatcagtaggccgaaatcaaaaaaatataaaaaaatcagcacgccaaaaataccaaattgccggggcgcagttggattaattgtaaacaattcaatataaatttggaattttacccttttcatcggctaagataatgatacaatatattgtgttgttttaaacagaaacactacatgtagtagtgtgacgtgactggttggccaactagacacctacaaccgcatatgaaaacggaaagaggagcatgattttgagtaattattttaaattcttatcacaccaactaaaaggttggccacaacagaactactatctattctattttagcctaggatgtcaagtaatgacgttagtaagtgcgccaattacagcattgtctattttaacatttattgggaccactttgggtgttctttgtgtgttagccattaatgcggctaagtcagtcaatggattattaggcgtcatctccgccgcttgcttcatcgtagttggtttttcagctaagaactatttaagcattggggaacaattagcctacgtcgtaacgcttgatattccagtactattaagtgctaattggaacgtcaacatggtttcaaagattcggaagtttacgggtaagacgtggatcgtcgcaattgtcgcaactttagttgtttatgccatctccggctatcttattggtgccttaactgatgatccccggccatgggtcgatgccattagttttgcgatttgtttaacggccggcgttatttgcttcctccgttacaacaaccagtatttctggtggattgcctctggtttagcacaaatggtcctctggttcatctcgttccgtcaaggttcggcgacactagcaatgttcattaatagttccgtttatctgatgaacgatgtcttggctttcactgtttcaccttggtataacaaacatgaacgcgctcggttgatggccgaagaacaagcagctagtgatgcagctagcgcggatgctagtgataatcaggcatttggattgaatcactaaaggtcagctaataaatttactgagactagtagcgttaatattctaaataaggcgagtactgtaattcttttggattagagtactcgtctttatttgaatagctccggattgtatcagttatcaaatatatgcttttttattgacattataataaacaatgttaaagtttaataaacaatattaaaaaagaggaatgctatggactggtttgtgaatttagaacgtgaggatcaggaatttgttaaacaattggttattgcctcaggttctctaaaacaactcgctaagatttatcaagtgagttatccaaccgtgcgaatgcggttaaacacgattattcaaaaaattaactttattgaggacaacggtgcaaatacgtttgaaacgaaggttatgaaattggtaatcgatgagaaattatcgttagaggtagcaaaacagattattactgactttagggaggaacaacatgagtgattttaaaggaattctgattggtatgttggtcgttgcagtgctctatatgttagatcgatacttaccaaggtggtttggggcaattccgggagctggctttttaggctttattatttacatggtttttacaaaagaggtctctttattatcaatagtaaccgtattgttagttggcgaagccgtgctgaatggtatctggatagatgcactcgtgaaccgaaagagaaaaatgaaaaaagaagtagcaacaatgaaagcgaaagatttattgcgaaaatagtaatattaatgaaatcatcagatatagaatcgacattggttggagattgctgttagcgctctgcgaatgtcgattttttattatggtgcggactatcctgctagttcaaccaatactgtataggtgctggcacttattatgaagcagttattgaatactgaaatataagctcggattttgtgaactctagacatgtctagacttgatctggatggtataatctacaaatttaattgggttattacttaaatattgacaacttgtctaaacaagtctatattcataaatgaaaacgataacaaaggggtggttgccgtgaataaagcggccttagtttatcaagatttgctccagaaaattgatgcggaggtttacccgatcgggagttatttgccgagtgaacatcaactttgtgagctatatgggatttcacgtgagactgggcgcaaagcattagcgacattggctgaggatggctatattcaaaaaattcgtggtaaagggtccattgtgattgagcatcgacagtatgaatttccagtttctggcattgtgagttataaagagttagccgaaaagttacacattaagacgcaaaatattgtttatgactatcaaccggatgcaacgttaccggttgctgactttacgtcacttggtaccgaattgacggaagcgccagtgacggccatcaaacgagtccgagtgatcgatggcgaaccagctattattgataaggattatattttgaaatcgatcgttccgaaagttcccaagcaagcggcggaagactcactgtacgcgtattttgaaaatcagcttgggttgacgatcggttacgcgacgaaggaaattacgatggcgccggcaactgatgaggaccgcgaacacctcgctattagtaagggcgcctatgtggcagttgttcgaagcgtgacgagcctcacggatgcgcgagcgttccagtatacggaatcacgacaccgggcggaccgctttagtttccgcgattttgctcggcgaactaagaaataagatctggcatgagagggatagcgcatgaaattatcagaacaagtgatttatcagatttatccgaagtcgttttacgacagcaatggcgatggcgtcggtgatttacgaggtgttattgaaaagatcgactacctcaaaaagttgaatattgacatgatttggtttaatccgttttttgtctcaccacaaaatgataacggttacgatattgcagattactaccatattgaccccatgtttggcacgatggctgattttgaagaactcgttgcaaagctgaaggcaaatggtatcggggtcatgttggatatggttcttaatcatacttcaactgaacacgagtggtttcaaaaggctttggcgggtgatgagaagtatcagaagttttactatctccgtcctcccaaggctgatggtagtctaccgaccaattgggaatctaaatttggtggtccggcctgggcgccgtttggtgatactggtttgtactatttacatttatatgatccgactcaggccgatttggattggcataatccggccgtacgacaagcgtgtgccgccgttgtcaatttctggcggcaaaagggcgtgcagggttttcgtttcgatgtcatcaatgttaccggtaaagctgagaagttggtggacgcacctaagggggtccctagcaagacgttgtatactgacacccccgttgttcatgattatttaaaggaattgaacgcggcaagcttcggccaggatgtagatagcgtcacagtgggggagatgtcttcaacaaccgttgcgaacagtgttgattatactaatccggctaatcacgaactctcaatggtctttaatttccatcatttgaagacggattatgttgatggacggaagtggtcccgaatggccttcgacttcccacgattgaagcaattattagatagttgggccagtggaatggcagctggtggtggctggcaggctttgttttggaataatcatgatcagccacgagcgctgaatcgctttggtgacgccggtcgttatcgtgtcaagtccgctgaaatgctggcgacggtcattcacctcttgcgtggaacaccgtttatctatatgggtgaggaactcggcatgactgatccggactatgacgatatggctgattacgtggacattgaggcattaaatgcttatcgggctttaattcgtagtgggtacagtcatcacgatgcgtttacgatcgttaagaccaaggcgcgcgataactcgcggacgccgatgcaatgggatgatagtgccaaggctggtttcactactggtaaaccgtggttgacaccgactaatcaggcgacgattaacgtggcccatgaattggctagtggcgagatttttgactattatcaacggctcattaagctaagaaaaacgatgccgatcgtcgcggatggtggctatcaatcgtggcgcttagatgatccgcaagtcttcggctattggcggacatatcgccaacaaaagttattagtgcttaataatttttatggtcagtcaacaacggtgacacttccggaagaaatggtcggtgcacaggtgttactttccaattatcaagatgttaatgtcacagcacaattgacgatgcaaccctatcaagcggttgcgctgttgttaggttaagaatggaggaatgggtatggcaaaggcacaaacagtaacaattttgtcgccggtcaatggggacgttattgcgttaaataaggttaaagacccggtcttttcagccggtatgatgggactgggctttggcgttcaaccttcaagtggagaggttgttgcaccagtcagtggtcaggtcacgatggtggctgagacgaaacacgcgattgggttcacaacgcctgatgatcatttggaagtattagtgcatctcggaatcgacacggtcgacttaaagggtgccccgttcacggtcaaagtggccgcgggcgatgatgttcaggcgggggacgtgattgccaccatggatttagctgctattcaagccgctaatcgtcagaccacagtgattttagcagtgactaacactagtgataaattggaatcgttggacgtcgttacgggggcaaaagctgccggtgacgtgacagctacgggccgtctgaacgccaacacatttaatgctaagcggcagaatcgattaccaaaagcgggtaaatatgatcagttagccgcggacatcgtggctaatgttggtggtgtcgagaatgttagtagtttgattcactgcattactcgcttgcgtttttatttgaaagatgagagtaaagccaatgatgacgtcgtgcgggacttaaaaggggtcatcgacgtagcaaaagcgggcggtcaatatcaggtcgtgattggtcctgctgtcacggatgtctatgatgcgatcatcaagcaaatcggaccgggattttcaaatgattcggagacggctaaagctgttgctgagactgccgcagcagctcagcggccaacgacgccgtggggcaaagttaaatggggtatcagtaatttaattggtgttatcacgggttcaatgattcccgtcattggattattagcagcctctggtattttaaaaggaattcttgcgttacttaccacgtttaatttagttagcccgaccgcaccaacgtacgtgattattaatgcgatgggcgactcggtcttttacttcctgccaatcttcgtcggttttacggctggtaaaaagttaggggcagatccggtgattatgggaatcatcggtggggtgctgacttatccagctattgtaacgatggcaagtggtaaagcgacgagtacgcttttaggaatggggatcaacgcgaacttctttggcttgccggtacacgttgcctcgtatacgtattcaattttcccgatgattgcgggggcctggctagcaagtaagttggaaccatggctaaaacgggtgattccaacggtattacgaatgatttttgtgccattatttgaagttgtgattgtttccggtgcgattctattattccttggtccaattattactgtgctttcaacgggattggcaaatattattgtgtgggtctacaatttgagccctgcgatttctggcttaatcattggtggcttctatcaagtattggtgatcttcgggttgcactgggcggttattccgattgtggccaacgatattgcaacgacgggtcacagttacttgaacgcgattgtttcagcgacgatggttgcccaggggggcgcagtattcgcaatcgccttaaagtcaaagctggctaacattcaagaacttgcttggccagcaacgatttcagccttctgtggtgttaccgaaccagccatgtacgggatcaacttgaaatatggtcgggcctttgtgactgccagtattggggcggcagttggtggcttcttgaccggcttgatgaatgtcaatatgtggggctttacgggttcactgattggcttcacgtcctttgttaatccgaagggcttggactttagtttttatggtttcttgattgcatccgcagccacgattgtcgtgtccttcgccttaacttggatgtttggttttaaggatgaggatgcaaatgcagttaaagtagcgcctaaaaagcgacacttaggtgcaaccgcctagttaatggcgacgtcaaataattaatcaacgttaggataaacaagtatttttccgattcggaaaaatacttgtttttgatatttagtcgccctaacgaagtgatggtaagtgatggagattggtctaattgtgatgatagaattttaatggatcatgattggacgtgagacggtcgtcttaaggatttttgaaggttaggttaagggttttacatgggggatgacgattatgggaaaaatcgatgaagtatccattttagcaccagttactggtcaagtattgtcattggcaacggttccggatcctgtttttgcggcgggaagggtagggccgggatttggtgttcagccgacagctggtcacatcttggcaccagttagtggtcgaatcacagtagtcgcaacaaccaaacatgcaattggcatggtgactacgactggcctcgaagtgttggtacatctgggtgtcgatacggtggcactcaatggggcaccgtttgaagttcacgtgaaggtcggtgatgaggtgacggctggcacactactagtcgacatggatttagctgctatcgagcaggcccacaaaccgaccacggtgatcattgtcgtgacgaacgctcagcgggtactcactgacttgacgctagccccactgccacaagctgtcgcggccggtgcagtcgtcgcaacggctcacttgataacagtgacaacaaccgcgtcaccggtagtggcagcggtaccgcagtcaacgacgcgttactcggcattagccacggcaattgtagctaatgtgggcgggcagcaaaatattaatagcgtgattcattgcataacacggttgcgattttatttgaaggatgaagcactagcgcacgatgcggttattgcgaacttggacggcgtcattgatgttgcaaaggccggtggtcagtatcaagttgtgattggtccggcagtcaacgatgtttttgatgcagtgatcgcacaactagggcctgaatttgcggacggagtgccagtaccaccggttcaggaggcatcaagtgacgttaattggctaagccacgtgcgtaatggcattagtggtgtcattggtgttatgaccgcggcaatgattccggtgattggcattttggcaggttcagggattttaaaaggaatcttggccgcgttaacgggcttcaaagtcttggcggtcacgagtgggacgtatatggtatttaacgcggtagctgatgcaacgttttactttttaccagttgtcctaggctttactgctgccaaaaagttaggttcagatccaatcgtgctggcgattgtcggtgctgttcttatctatccaagtctgataacggcagctagtaagggagccacggcccaaatcacgttcttaggtgttccgacgcatttaatgtcgtattcggcatccgtgttcccgatgattgtggctgcatggctaggcgtgtacgttgagcgggggttaaaacgagttgttccgctgtatttacggagcgtctttattccgattatcgaagccctgattttggcgatagtggtattagtggtggtcggtcccttaattacgattatcagtaagggcttggccaacagtttggtcgccgtctataattttagcccggccttatcaggattggttattggtggtttataccagacgatggtcattttcgggctccactggggcattattcccattgtgatcaatgatattgcgacgaatgggcacagttatttgaatgcaatcctctcgattaccatggtcgctcagggtggtgcggtgttggccgtcttcttaaagtctaaggataagcacctaaaggagatctcactggcagctgcaatttcagccttttgtggtgttaccgagccggcgctatacggggtcaacttgaaatacaaacgggtctttgtcgttgctagcattgcgagtggtctaggtggcttactgaccggtctgttacgcgttaataactatgctttgtcagggtcgttgatcggtttccccgcgtttatcaccccgggtgtcggcatcgggtcaaatttttatggttatttgatatcccattacgggacactagtgattgcaacgatgttagtttatgtatttggcttttcggataagttgttaggtcctaaggaaaacttaaaagcgactaataatcagtaactaaaataaggctcctgctgaacgtagcgggggtcttatttttatgaactaatcgcttgcaagcgtgcttgttgtcgaatcgcttcaacataaatgcggacaaagtcggtgccatacaggactgctagttgctgttccagatttggtgtgggtggcaacacctttagcaagggtcgaatccattgattggtgggcaatagtcgcaatagatggtggctggtgaactgtgagaataggagattgcggccgaagtattgtccaagatgattttggaaagctggttgcttaactggcaccagttggagactactgttattcatgttgcctagtaacaatttggcctgaccaaagtcgtcacgaaggtcaaaatgctgattcttgtaggccttagcgatttcaggtgctaattggaccaaccaaatgagctgatgttgttccaaatgcagaatcaagcgcagtgtcataatatcagttgtcgtgagttgataactgtattgttgcagagtggctggtgttaattcttgacgcaaggtccgttgaacggcgtcaaaattaccagcctcccaactaatggttaattgatcatggttcgtcagccatagcaaatgatccgcgatccgcaaggtcaaaaagcgcggggcagccgtccccggcgtctttagcattagtagccagtaagagctggcactagaacgcgcaaaattgcgtgctaagacgtgcgcacaggttggcaaggctaattggacagccaattgtaagcgtcgccggtcagtagcagtattaacaaactggtgtgggtcgtgtgtgattcgtcgttttgccatagacatccctccctcattaatacactaccttaattataggccaaaaaacgtggtgtggcgcattgaatgtttggttttaatgataaactgttgtggattagcttctcggtaatttatatggattgcgacataaaaggcacgagtgaataaatgacaaattgcaatgataattaccgcaatatgggcaagttattgcgtgatatatgcatttcgcttgttttaaaatataaaatatacaaagcgcggctcattaagaattgtataatgatgggtgtagtcaatcttttcatgatataatagccttgtttacattcaggtgtgtacattgatttaataaagattaacgaagaaattttaggaggagttttactatgaagcgagttattacgtacggaacgtttgatttattacattatgggcatattgaattactcaagcgtgccaaatcactaggggattacctaattgtggccctatcaaccgatgagttcaactgggacagcaagcaaaagaaggcctatttctcatacgaaaagcgcaaggcattactagaagcaattcgctatgttgacttagtgattcctgaaaagtcgtgggatcaaaaagtaagtgacgtgaaattataccaaattgatcgctttgtaatgggtgatgactggactggtaaatttgatttcgtgggcgaacaaactgacgctgaagtcatctatttaccacggactcctgaaatctcaacgactaagattaagcaagacttgaatttcaatcaaaaataaacgtgtgacggggaattcaataaaatggcattaaaagatattatcagtcaggtttatcgccgactgttcaatgtaattgcgactgtgtgcccagtgagaaaacacgttgttttatttgaggcgtttaatggtaaagttccaatggataacccgctatacgtttacgaagcacttcagaccgcgcatccagattggaagctagtctggggtgttaagcgtcagttggttgtggaagcccaggaaaagtatcctaagttgaatattattccacgcttttcggccaaatggttattagtggcaccggttgcagaattctgggtcctgaacgcgcggatgccgtattggttgaagaagaatgcgaaaacgacctatattcagacttggcatggtacgccgctaaagcgcctggggattgatattccaaaagtttcaatgcctggtaccgatacaagtcagtatcgtcagaattttacggcggagagtaaacggtgggattatttaattgcacccaatcagttttcaaaagacgtttttcgacgagcgtttgattttaacaaccagttcttggattatgggtatccccgcaacgatcggttagtgcatcagcgccaggattatgatgcgattgcagcgattaaaaaaagaattgttggcaataagatgggcaaagtaattttatatgcgccaacttggcgagatgacttttttatccgcaaaggtatgtataaaatgaacttgccttttagtttggccgcggttgttaaaaggcttaataaggaagatgtgcttattattcggccacattacctagtagctgagtcgatcaatatccaaggctttgaggacaatgttaaattatgtgtggatgaagatattaatgatttgtacttaattagtgatttattgattacggattattcttcggtcatgtttgattacgctatcttgaatcgacctatgctattttatccttatgatttagcgcattatcagggtgatgttcgcggattctactttgattacaacaaggttcctggtccaattgtcaccaatgagcaggattttctggccaagttagatcagttcttgactaatgatggttatccaaacgaaacagccaagatgatggcatttcggacacagttcacggaatgggagcaaggaacggctagtcaacgagttgtgaagttgattactagcatagatcagaacgcaaataattatacaggctaatccattagggctagagtactgtagtcaagcacaaggagtaatgatatatattatgggaaagatgaataccatcaaactcgcgtgtaagtttgttgcacggccaattcgggagtttgtaactaagccggcaattcgtcaaattaatgtttatttatactatgtgaaacatagcaaagttcaagaaaaggctgttttcttggaatcgtatcatgctgtcaatttgactggaaatgtgtatgcgatgtatcaaaagatggtacaagaatatccggattatacgtactattgggcatacaaagacaaagatacaattcctgcggatattatggcggataccaagagacatcgggtatatttagttaagtacgaatcacgtcagtatatgaaagccttagctacctcaaagtatttaattaacgatacttctttcatgccctattttatcaaaagggatgggcaacggtatctgaatacttggcacgggacacccttaaaaacactgggattagatattaagggttcaggtagggcagaccataagaacattcagcgtaatttattggcagctgatgtcttagctatgcctaatcagtttacggctgagcatttaattacgagccatgatttaaacggtatttttccaaatgaagtttatattactggtaatccacgagttgataacttactggggacactagtttccgaggatacgcaagcgttgaaagagcgcttggggcttccagctgaaaagataatcttgtatgcgccaacttggaaaaaagatgtggaatatactactgaagctgatattttacagttgttaaatgaagtccaacgattgcaggaacgtgtcccatctggctacaaagtatttttaaaagtacattattttatttatgataaattagttgaaatgggatatggtgatcaattaatttcaaatgccattgataccaatacattgttacgtggtgtggatgtattgattacggattattccagtatctttttcgactttttgccgattaaacgacctgttatgttttatgttcctgataaggatagttacgcacagaaccgaggcttttacaagtcgcttgatacacttccgggactggtcacggataagtttgatcaattgcttgatgactgtaatcaaaaatactttgattcgtgggccaagacttacgaacaacagtacaatgattataaatccgaattcttgagttatgatgacggacaagcgactgatcgtgcagtgcaagtattgtttgaagagtcgtcatcgattgagcgacttgatttcaacaataataaaaagaagttattgatttatgctggaggtttctataataacgggattacaaattctattattaatttgtctagaaactttgacactaataaatatgaattagtatttgttgattatccgcggatgcgccctgaaaaagaatataatatgaatcgcttacccggcagcgtgcactttatttttaatttttcatgggcaactagaacattctttgatacttataatcagaacactagctaccacttcggatttaattcaaagttagttaaccaaaataagatgaaggcaacgtaccagctgaattttaggcgtatctttggtaactttatgccatacgaagttattgactttggtggttacaacaaagctattactggattatttgctttatcaccggttccaaaaaaggttgtctttctacacaatactatgtgggatgaatataataaaattgttaatgggcgatacaagcatcgtaagaatctgcgtgttacgtttacttactatcaatattttgacaaaattatttcagtttcccaatcagctgataaacaaaatcgagaagatttgagtcagtatgctgattctgctaagtttacatgggttgagaatttagttaatggcgccgaaattgaaaaagaattatctgaggtaaagcaacaagtggataatggtgattcactgatagagcttactaaaacagagacaccaagcggaattattacaactcaattatttcatcctgtagatcagaattattttaattttgtgacggtggcaagactgtctcctgaaaagaatcatttaggattaatccaagcatttaagttagtacatgataattatccgaagacgcgattatatattgtcggaaatggtccaatacgactggaagtagagcaacttatttccggtttaggattagatgaatcggtgttcatgatggggtttttgcagcatccaatgaaatttgtgtcatttactgattatgttgtactgccatcagttacagagggtcaagggcttgctattattgaagctttgcttgcacacaagccggttgttggaacagatgttgctggtattcaagatgtaatcaagggcggacgttttggcttgctgagcggtaaaaatgccgtagcaaatccaaatagtttggcgaatactttagctctctcaattgagaccaaggacagtatcaagtatgtaaaaactgtaaaagagccattgaaaatcttccatgctgaaacccaagttgacggtaaatgggttactagctcagatgattgggaaaatccagatatcgttttgggaaatggtagcaacgggcgtgcattcgttgaaattaaacacgttgaaagttacccgaattacgcagtgtttattgacggaaagcgtgccgctcagaacggtcaacttgctcattatgatgtacaaaatgatgcagcactaatgattgtgctagatatggagcaacaggtttgttttgaacgttttgattggcgggagtataatcaagctgctcttagagaatttgaaactagagcaattgtttgagctggtttcagttaaataacgaatagttgacaagttgtttgtttacttgctaatacaaaagagagtcatagatcttttcaaatttttgaggaaatctatgactcttttattaatgctgttggcgtagtcataacagattcaattgacatgccaattactaattaatattccatttttgaatattaattagtctaaacttgatttgtttgtagtatttttgcaaggtatcatagacaggtaaatgactaattttataattgtagaattgccgaaacgagggtgtcaggatgaaacgaattgttgtgggaatcacgggagcgtccggtacgatttacgcggtcgacttattagaaaagttacatcagcggccagatgttgaagttcacctggtaatgagtgcgtgggctaaaaaaaacttggagttagagactgattactcgctcgcgcagctaacggcgctcgcggatgctacttatcgggctaatgaccaaggcgcagcgattgccagcggttcgtttttgaatgacggaatggtcattgtcccagctagtatgaagacggtagcggggattgcgtacggcttcggtgataatttaatatcgcgggctgctgatgtcacgattaaagaacaacgtaaacttgtgattgttccacgtgaaacaccgttaagcgtgattcatttagaaaatctaacgaagttggcaaaactcggtgcccaaattattccaccgattcccgctttttataatcatccgcaatccattcaggatctggtcaatcatcaaaccatgaaaattttagatgcgtttcatattcataatgaaactgatcgccgttgggagggggattaagtatggcaacttttacgactgagcaggccgggtatcaaatgcaagcaacactccaagtgattggatatgacttgttgatcgtcgttaccggtgggaccaatccccatattggtgacgtgaccacactaactgccagcacggttcccgaaacggttaagtttcccagccatgatggtcgcttccataaagataactttatttcggaacgaatggccaagcggattcagcgttatctagttggaagctgtacaattactgcgggaattcatgtcaaccaaattactaaagcacaaatagcagctgcggcaccaatgacggatgacctcagccgccagattattagctggttacaggcccatcccgtccaggctgaaaagccggaatattatggacaagatgagcaaccgcggtagattcgtgacgcatggggtgtcgaaaacagcgcaatattgtcttttcgccctattgctggataatatgcaccgagctggccgtttattgttattaaagttgtactagatgaaataattcaacaaaaaaattgcgcttcagatgttgattctgaagtgcaattttttgtctaagttaggcataaacatactagcatgtttgtatttaaacggagtggcttgcagggtgaattataactttagtatcgacatgcgcgctggcttccgcaatcgtacaccgtcagctaatctggcagcttatttgtgggcatctttctttgcttgttccactaaaatattatcgaccacgtcttgtaagctagtcttagctaaccgtgcttcggccgccgtttgcgcgtcttgatagtattgtttcagaacggtttgaatattgccaccaacaatacaatccggattggtcttaggatcgacggcgagtagcggcttatcgccctcaattgcgtagaagacgctgagcagtgaaatttgacttaaaggtttggcgagtgccggttgagcagtaccgggcgttgttgtgattagtccggcttgtcgaagcttgctcatcaatcggcgaacaacgactggactagtttcaatgctgcgggcaatggcgtcacttgttaatttagtatctgcgtaaattttaatgtaggctagtaaatggatcgagtcgctaaagcgggttgaaacacgcatataatcacttcctgtaacttaattggttactatgattataaataaatccacttataaaagcaattaacgagtttagttaagctgatgatgtaacttttataaagatggttgttttgggggaccgaatcagttatgatgtaaatgccaaaattgagcagttactgcaaaaaaggagcttatcatcatgagtgaaattgaaaccatccaggcctattatgcggcttcattgggaaaggatggtcgtattacccggacccaacggcaaattttagccgccgcgctcgacttatttgcagaaaaaggttacgaagaagttggcactcgggagattgcagagcgggccggtgtcgctgaaggaactttatttcataattttgttaataagaacggtattctcgacgccattatgcagccgattgtgcagaatattttgccaacgatgttgaacactttggatcaggcagttttagatagtcctaaccagactttgcaagcatttgttgtcgcccttgtgcgcgatcgggtcgcatttgtcacacgtaaccgagcctccttagccgtcattttgtcccaatttttcaataatgctcaggatcgagcggccgtcttagggatggtctcacctagcattttggcgcaggcgaatgaagcgatggatcgcttgaaagccgctcgagaattagttgattggccgaatcgcatgattttacaattggtgttttcaaccattgggggatatttagtcgaacaggttctctacccacaactggatgatttgagtgatgagcaattgattcgctatctcagtgattttttagttaatggtttgagcccacggagaatccccttacaagatgataataccgcgtcataacaagctttagggatgccaaagtaataattaataatagttgactaataggttaatggtgctatactaccaattggaattaaagtgagtgctcaattaaggggacgcactgttgaggatcacgtagtagtccacaacctgaattctaaaccaatagaagagagggtttcataatgaaatcagcaaaaacgaaggatcacgctaagatgaaagctgccgaagaaaaggcgattcattcaacgggtgccgatagtaagagcttggacgaagtcaatgggagtgtccgggtccctaaggatgccagcttctggcgaaccttaattgcctacactggaccgggtgcactagttgcagttgggtacatggatcctgggaactggatcacatcaatcgcaggtggatcacagtacaaatatgcattactttctgtgatcctgttatcaagtttaattgccatgttgctacaagccatggccgctcgtctgggaattgtgacgggtaaagatttagcacaattgacgcgggaacgaacgtcaaaaggaatggggatttttctctggattattactgaactagcgattatggcgaccgatgttgctgaaatcattggttctgggattgctttgaagttattattcggatttccattaattgtcggtattttgattaccactgccgatgtcttgattctgttattattaatgaaacttggcttccggaaaatcgaggcaattgtggcaacgctggttgcggtgattctcttcgtcttcctatacgaagttattatttcacaacctaatattccagaaatgttaaaggggtatgtcccaactagtcggattgtcagcaaccgttcaatgctattcctagcactcggaattgttggggcaaccgttatgccacataacttgtacttgggatcatccatctcacaaacgcgtcaagttgaccggagtgacgaaaaagaagttgccaaggctgttaagttcacgacaatcgactccaatattcaattgtcagtcgcgttcgttgttaatagtttgctattaattcttggcgccgcactgttctttggaactaagggtgatcttggccggttcgttgacttgtacaatgcacttggcgatagtaaggtcgttggctcgattgcgagcccgttactcagtatgctctttgccattgcgctgttgtcctctggtcaaagttctacgattacggggacgttatctggtcagatcatcatggaaggttttatccgtttgaagatgccactctgggcacaacggttactaactcggttaatctcggttacaccggtgttggcttttgcgatttattatcatggcaatgaagcgaaaattgaagatttgctgacgatgtcgcaagtcttcctgagtatcgcgttaccatttgccatgattccgctagtcatgttcacgagtaatcgggcgctgatggggaacttcaccaaccgtgtctgggtcaagtggacggcttggatcgtgacggtgattctaattatcttgaacatttaccttattttacagactgtcggtctggttaaataagcaaacattaaaatgagctttctagggattacaaggattcctggaaagctcattttgtctttcgggagcagcggcaatgcaagataccgattcaaagtgctaacacgtaacggcaattggcgcttaactgactttggatggccagtcttgcttagttggtatgatggtaaacggggtcgcagtgatgaggtccgtgaggcaggggagcaatccggtctcaaggttatataaatcgtgaacgtgtgcgctagtttgaccatgctcagccatcttaagtagctgggactgggtgaactggagttgactggctggtagtatcaggtccggttggctgcggcgtgttaacggttgagcgtggtcgtgaactaggtaagcaaaattaggcgccgtattgagaattagcgttaaaacgctgatttcatggggatctaatttggttgctaactggttcgtttgactaggggaataaaccatggcggcgtagatttgaggcgccagctcgggtaattggcggctaggcggtgtcagggtgaccgtcagtcccaattgccagctggcgagcaacaatcccggaatcgttacgacttgtgcggggctcagtagaatggcttgtccggcatgcacgttctgttgttgcagactagtttcacacagtgcgaggtcttctaaaacatcggccccggtataccagttgccatttagatctttcagaactggttcggcatattgacgttgtaattggcgggtaatggccttagtcagctgactcatcgcggggcctcctttaagggcttaagtgacggggcggaaattaagggtggcagtactactttgcgttagtgagatacttcatcttagtgatactctggctactagcatcaatggttgctaacacttgattttgggtggatttaacaacaagcttagttggctgcggtgttaaatcatgtttcggttggctagtcgtggcacccgttgcgagtttagtatcacgagtgactttattgacgagtgtggtggacgttgtctcatgcttagttgtcgtcgtatcagcagaggcggaaacggaagtggcaaagagggttccggcggccattaaagttagggttagttttttgaatgtgtttttcataataatcgaactccttttagttgttattatcggtggcggtcagtgaatgattattgggcagctggcattaaccagtcgttagagagtagttgatgaaagtgacgaccaagtggcacccataattgcgaacggcggatgttttttaacgtgtcccagaataatggatcttgtagttgttcatcactgagtttgactttaacgaattcgccatcttcagtttttgcaatcaccagtgggtaggtcaccttaaccaattgaacggcggtgatatttttaatttttggatcagtatctaataacatatctacatagctccttagttgttgtgagtcattctgtttttatgagttaatttttaaagttggtttgtttaattgaatgactatagtttaccggcatatcgccgtggtaactatcgactttccataaactttatctaagaaattcttagattcagacttagaatataaaaaataccatgaaaattgaatctgagcaggtaatactttggcaggatcaagtactagttaaattaacaaccgtttcaagactgttaatgtccttaaaacggttgttaagagtttgtttgtaaatgaattagcttagtgtgcagggcggttaataatactaatggcaaagcctaataaagcacaaataagagaaacactaaaggaccaggttaaaccatgggcaaaccaagcaggatgtgctggcaagtaagtactaactcgatatccagcatcgatgctcattgttgtaaatagtgcaagagaaccaagtgcgacgcctaaaatattgccaatatggtagattgcaaatttnnnnnnnnnnaattttacaatctaccatattatttcccaaagactgtagagaacccgctactcctagctgattttgtgggacgactgacattagtaatgtgttatttggtgcaatgaaaaatccagtgccgataccgttggaaattaacaaagaaataatgagggttaatgaagtatgtgaatctaggaataagaagccaatttgcgtaattataattaggactaggccggttagtagaacaagctgttgagagaaaagatcactcaaccagccaccaagtggggcagcaatagccataataagtggaaaaatcagcattaatattccagtagtaccaactgaccagtttaaataatcttggagatagagtgggaatataaagctgaacagtgcattaataagtggtatcagcattccgactagcaatgctaagctgaaggtacgattcttaaaaatggatagtggtaatagcgcattttttcgatgcttttccaaataaataaagtatagtgtaagtgctaatgtgataatgaagccaatgataattagcggctgcctgaaaccaatagtctgccctgcttctaatacaacaaagaatagtgtgatgataatgaatagaatccctgcgccccaaccatcaagtttagtggcttgttgccggccatgatttttgggaagaaataggtggcctaaaataatggcaatgattccaagtggaatgttaatcataaaaatagcattccaagcaaactgctgtagtaaaaagccacctaaggcaggtccggcaacaaaaccagcggaaataaacattgtattgatacccatggcagatccccgggtgtgattatcaaacagttccgaaattaaaccatagctgtttgaaagcgttgcggcagcgccaactgcttgcacaaaacgagccaatagtagaaactcaaagccgaagttgacactggccattagtgagccgatagtaaagctatacatacctaaattaaagattctacctttaccccaaatatcaccaagtttaccgaatgttaccagtaagcctgatagaatgaccatataacccatcacggtatatgtgatctgactaattggaaccgcaagtgattttgacatgataggtagcgcgatattaatgattgatgcatcgagattagccataattgtaaaaataccgatgacaatcattgctaaccaagaacgagttgttgttttcatgataaaaattcaacctcctattttttgaacatttgaaagtataacaagttcgtgttacactaacgcaagcaaaatttaggaggatacgagtatgtttacaattacggcgaccgctcagaaatatggtgtgtcgaataatgcactacgttactatgaaagtgttggtctaattggcccgattaagcgtgatcaaaatggtatccgacaattttcggctagtgatcaagagatggttaaccgaattgtacatctccggcaattaggcgcgtcaattaaagagattcagcaatacagtttccgtcctgaagaagtaacactagaacgtacagttgcactaaaaaaatttctgttacgtctaaacggagatctagaagcacaagaggcgcaaattaaaatagaaaaacaatatttaaaagcaaaaatagaacatttggatggtgatattttgagtatgaaatctcataaaaccacgcagatgggttagtagtaactagtttctgaatatcaattcagaatagtcttggaggtatctttgtgattgggtggcccaagaccaaaagcgagtcctagatttttctagtgactcgcttttttatgagagtaattatttaggaaataaaataatagtacttgttactatagttgccagctgaccgtaaagacactcccggatggctggttgtcggtaattttaatggtggcctgattcaatgtgactaactgttgaacgattgctaagcctaggccactgccttcgattgcttgtgaccgagattgatcaacgcggtaaaaacgctgaaagacagcctgtttttggtcgtctggaattccctcaccatggtcggctacagctagttcgactgcttgatcagtctggtgcaaactcaaggtaatcggttgatcatgtggcgagtatttatgggcattatcgagtaaggccacaacgatttgttgtaacatttccgcattaccttgaacgtggatgttcggatcaattgcgagcgtcaatggttgatcaattgacggctggtaatgttcagccagtgacaacattaatagtgataggtcttggtcggttaagactagcttagcgcgatcagctcgtgaaaggtgaagtaggttctcaatcagatgttgcattcttagtgattcttcatcaataaactgtaatgattctggaatcacttcggggtgggcgtcaccccgccgcttgattagactgagattaccgcgaatcgcagcaatcggggttcgcagttcgtgtgaagcatcagaaataaattgacgctcatgctgcaatcgttgattttgcgtgaccaatagttcattaaaggcccgaccgaggtcgttgatctcgcgggggctagcaggcacgtctaaggtgggctggtcgctatctggattgttcgatgtgtacttggttgcgtgtaacagtttaatggttgggtcactcagtcgcagtgctaaacgatgggcccaccaagtccccaatgccagggcggcacaagtgacagccagcatgagcagaatcaaaataagcagactgttgaacaatcgccttaagctgacccatagttggtaagtgttatgcccatctttttcactataagataagaagaaaccaaatccgcgaacgtagactaacggccctactagcttagtctgttgcttggtgaaaaacgatttggacgatggggtagtgatgatcgtccgcttcgttttagtggcggtcgtcaaggttgctttcttggtggttacccagataaatgccggttgtttcgtattgcgtgtcgtcgtattgttccattgaataaaactggggacgtctttgatattcgcctggttaagactgctcatcaagtcacgggcttccctagtcgtattgattgtttgctgagtgccgaccatcagaagggtgatcaagctaaccaacaacgtaattgtcagcattagtcggcggatggccttattgatcagctgttcataggtcggagtggtgttatttttgggcatcagacatcggctcccttagtttatacccgacgccgcgcactgtttgaatgagtggggaggcgccggttgtcgtgattttattacgtaaataaccgacataaacgtcaacgacattttgctgaccgagaaagtcggcgccccagacttggtcaagcaagtcatcacgggtaaagacttcgtcgggatgagcgaggaagaattgcagcaaatcatattcacggtgagttaaggtaacttcttcctgcccgttagtaacgcggtgggctttggtatctagctggatatcatccagttggtagacttgattgggttcaacttgattttcaatgcgtcgttggataacccggattcgggccaataattcttcgatttcaaatggtttggtgatatagtcgtcggcaccattatctaacccggcgactttatcaccgacataatctctagcggtcataataatgactggtacttgatcgtgtttgcgaatgcggcgaagaacttccataccgtcaagttttggcaacatccagtctagcaggatgaggagcaactcgttttgatgcgcttggtaggtttccatagctgtcaaaccgtcagtcgctaccaaaacgttgaaatcctcaaattgtagttctttagtcaagtaaccagataggctaccttcatcctcaacaattaaaatcgtttttttcaatgttatgctcctctcaataaccctggtttatgtctaattatagcgaataattatgacgcttttccgatattttgacttatttttatggatttgtgtgaactaaatgaaagcgtcaccggacttatgctaaaattggactatgaaaatggaaggtaagtgagtgacatgggactttttcgtgacgccatgcaggcactgtatcacagtggtcattatggttacaacatcaatgtaaagaagtcggctcctgccgttgatccgaaggaagtaccagcgattgcggcgttaggacgtattaatcgaacgcccaactttaagacgtggtccgttgattcgccatataaaacggccgaatttacggctaaattaactgacgcagtagcaacttgtgatttggaaatgcgggatcttgagatcaaaccgcagatcgatggtcggtggggcgatcaataagcggaatttgttcccataaattctaatggtcatattaatttaatgatagaccaattaatcaatagtgacggggtgagtcaatgttttcgtacgatcaggtccagcagttaaaccgcttggaaattgaaatttataagtatattgtgggtcatcccgctgaagtaagtactatgacgattcgacaattggccgaccatagtcacgtctcagcaacgactattttgcgttttctaaagcacatgggctatgatggctacgcagaatttaagttcacattaaaagaacagttacggcaagatgccacacaaccgttagctcagacagttataccgatgcggacgttttttgaccgcatgaacttacccgatatcacggctaaacttcatcgggtcgcagaactggttcatcaagctcgaatggtcgtactgattgggtcagggacgagtgctggcctggccgcgtatggcagccatttattcgctaactttggtttatatagcttgatgattagtgatacgagtcagccccatccggttcagcaacaggatttatcggataccgtctttttcgcactttcagtatctggagagtctgaagatattattgaacaaagcgtttattatcggcagagtggcgcgaaggtggtcgctattaccgctagcagtcattcgacgttagctgggattgcggacgtggtgttaacttacgataccccggaagttcaagcaatcagtggtggtagcaccttgtcccagttgcccgtcgtttattatctggaacaattagctatgattattcagccattaacgtaaaggtaattcaaaccaatctttggaacatgttctaaaaatagaacaaattccgatggatggaacaacacccattttagagtgaaagggtatacattttgagaatgacaggtataatgaattttgtaggaagcgtattcatgggtacaaatgtcagatgacaggactactttgtaacggacgaactcaattttatgtaaacggttaactattgattgaccgttagcttacttaaattattctgattgtttgagaatgttcgttaaatgaatatgcacaacaaattattttagggggtcacgacatgagcgaaaacaataacaagtcgagctttgttaatgaccgagttgtccctttctttggcaagattgctggttctcgtcacttaattgccttacgtgatgggatgacattggcagtgccaatgattattatcgggtcggtcttcatgatcattgcgcaattccctatcaagggttatcagacctttatggccaatacctttggttcgaattgggcaacgatcgtccaatatccaactaacgcctcgttccatatcatgggcttgattgcggttattgggatttcttataacttggcaaagagttataaagtcgatccaatctctgcctcaattgtttcgttaggcgcttggttcttaacgattccattaaacaccgataaggcaggagcactgtgggtaccattaacccaacttgattcggcggggttattcacggcgctactgattgggttgtttattactgatttttacgttttcatggtgcatcgcaattggacgattaagatgcctgatagcgtgccaccggcagttagcaactcgtttgcagccttagtacccggttttgtcatcttattcttgatgtggttactgcggttggctgttgaagcatcaccaatgcagagtattcctaacgtgatttcattcgtcttagctaaaccattaggcttgttgagtaacacgttaccaggggccttggttgctgaattcgttgtatgtattctttggattttcgggattcacggtgccaacgtggtttctggggtcatgcaaccaatctggttagctgcgatgtctcaaaatgcggaagcgcttaaggctggtaaggctttaccaaacgttgtgacacaacaattcttcgacaactttgtccacatgggtggttccggtgcgaccttgggactggctttcatgattgcctttgttgccaagagtgccgaattcaagacattaggtaagctggttatcggacccgcattgttcaatatcaatgaaccaattgtcttcgggttgccaatcgttatgaactatcggattgccgttccgtttatcttggcaccgttagttaatgttacgacgacttacattgcaatgtcgacgggcttagttgcaaagacggttggggtcatggttccttggacgacgccgccaattatctctggttacttagcaacgatgcacatctcaggtgcggtattacaaattgttaatattgtgcttgatggtgccatctactacttcttcttcaaggccttagatcgtgataaggttaaggaagaaaagacctttgctgctaaagaagctgctggcgaaacggtcgaagcttaagttaaatcattaatgtagtaatcgtataaataccaccattagcgacttgctgaaagtctgttgatggtggtattttaatgtcgatttttgagaagcgcgtgcagattaaagcgaaccgagtgacttggaattgtcaccgggttcgccttttattaacgggtatgaaattgtgggtgcaacattcgggggtgaccatggtcagtacccttgtactgcaatagccaataagcgttttgcggcaaagcgctacgggcaatgacgtgtgcaacggtgtagcgaatcgtgtcggcattagcgtcagtccataaacgccaagttggtaacttagctgcttgaaccggttcccaatcgcccaattcttgttcactagtagttagtgcggtgagtaaatcaggccgttcggaaccagtcagttcgatgtagtagcaatacgcttgcggatgcagggtgttgggctggctcatgatgagattgctcctttggatggttttaacgagttatcgttgacttaaataaccttatcatcaatcatagtacaaccgtttgactaaattgactagctttttcgcttactgttattaaaatgtaatattcaaacttgcaattaaaaataattgagtgttgcgccttgacctggaacgcgtttcatcacgtatattaagtggtgaaaataacgagggggtgcagcacgaatggaaacgggaattttaaaacagattgatttaacaacgacaacggaacggtatttcttcgtgcaagtacaacgactggccgactatgtctggattcgctcagttcaaaactttaagcctttagaattaacggttcgggtgagtgatttacaggtgaacaagcaccaggccgttgctgaccgggggaatatcaaatatgagtttaacgacgataccgggggactggtgacgcaacttgctggctgggtgcactaagacggtgacagacaagcagtaactgtgatactttaggcaatcaacaaccaataatactaatggcagcaatcaattttaactaggctaggactaaatcaggcgcgccactgaaggctataatgcttcagtggcacgcctgattatcattaaaagatcacttggtattatcactgtaagtgattttatctaaaccttgggtgtcataattgagattggttttgccgtcatacacggtattcttggcatttagcttggtttccatgttggtaagggtctcagtactgagccccagttgggtccgaaggcggtccgacgtttgttgcaaggcctttgtacttaaaatctgataggaactcgtattgatccaagcgggtgagccaatgacttgagtcgactggatgtgtttcatattggcacgatcatgcgtcgctaacccaacaaggtcgttaaagctaaggtcagtttgtaaattacccttcagtgaagtgagtaattgattgtagcgactataggtcttagtctcggcgagtttggcgagaaccgctcgcatgacttgttgttgccgtaattgacggccgtagtcgccccgggggtcctgataacgcatccgtgtataagatagcgcctgtttaccattgagatggtgtttgcccttggttactgtgatgtggtcgaatgaaacgttgagtggactagtgatcgtcacacctccaacggcatccacgatttgtttgagaccgcccatattgatagttgcatagtaatcgataggcacgttgaatagcttgctaacactagccttggccatcttggagccaccaatattgtaagcggcgttgagtttttgaacatttgtgtcctgatcaccgaccatttctgctaatgaatcgcgtggaatgctggtaatgagcgttttcttggtctgcggattgatcgtaacgaccataatggtgtcagaatttcccttatcaatacgaccgtctgccccggtgtcaacacctagtagtaagatgctgagtggcttagtcgtatcgattttagtactgctgtttcccgtatagatcgtcgattggtagcgcgcctgtgcctggcgaataattaagccaatcgctacgaatgcgataacgataatgatgccgaccgcaattaacactggccgtaattttgaagatgctgaatgccgcatgttcaaatcctcccttaattaaaggcgttaagatggttccccggataacgtctttgtcttgaaatcactgtttctagcatacccggtcagtacgatcccggaaaatacttattttgagtgtacttaatttaaaaaatagataccacctaaaagaattagattggaaactgagcaaattaggagcggtcacttacggacagtattacggcagaaaacggattcttggcttatactgacagtgaacttaaatatatgaagtgaggtttggtaatttgacagtctttcgcgcattttctaaccaagaagttttagattatttagcaacgcaagtcactgacgggcaggtcttcactgacgaggagacgctgaaaaaatactctttcagtccgcggttgaccgatgacgatagtggccttgccttagcctatgttgaagcacatacgaccaaggacattcaaggaacgttgaaaacggcccgtaaataccacatcgcagtgattccccaagaccaaacaacgagcactgttatcggtgcggacgggttaacagacagtctgattctttcaaccgccaagatgaaccgaatcatcgaaattagcaaggctgattccatcgccgtggttgaacccggcgtcgttaacggtgatctggataaagaagcacgcaagcagggtatgttctacgcgccggaccctggttctaagcccatctctgggattggcggtaatgtggcgacgaacgctggcggaatgagtacggtcaagtatggggctactaaggacaatgtcttaggcgttaaggtcgttttagccgatggtcgcgaagttaagttaggcggtcggacgctaaagcaggactttggttatgatttaacgcaattgatgattggttcggaaggcacgttaggaatcattaccgaagtaatcgttaaactgttgccgattccgctagggacccccgtgatgggcgtcgcctttttcgataatatgacagccttggctaaagcagtcacggcgattcgaatctccggtgtttatccaacgatgttagaggcattggatggcaatacggttgcggcactcgatcgctacgagaagacacactatgctaagaatagtgcggcgatgttgatctttaagcttgataatggtggtcaggatagtatggcagtcgttaagaagatactggccgaacagcaagccaacgatgttaagattacgactgagcctaaggaacaggcagcgttagaacaattacggcgcgacatgctgccggcagtttttgctggtcagaaccatattatggaagatatggccgtaccattatcgcaactagccccattgatggactatattcaagacctatccaagcggttggacgttgacatttacacggctggacatgctggtgatggcaatgtgcacccgaccttggtgtggccaacctcagcaaccgaagtgccagaaaagattattattgcactacaagaaatgtttaagaagacgctggcacttggtgggacgatttcgggtgagcacgcagtcggaatgttgaaaaatcaatggaacaatgccgaattaggcgaagatgttgatatgttgcaacatcagatcaaggcactctttgacccgatgaatattttgaacccgaaacgtaaaatcaattaacccaacgattacaaagcgcttaagttttgatagcagttgttggtcagatattgcgtaacttggtcatcgtgtcttattattgagatagtcccaaaaatgagttgttggttaatgagtcactaagaatgtgcagtgtggattaaccgatgcgaaggaggccccaagtgatacctaagagtgcacgaatccgaattgaatttgatgccgaagtactccgcaacgagatttttgatgtgcatgatttcgccagttttcaaagcttctggcagcgatttgagaatttcttggccgatcgcatggtcgttggtcacctgaacgtgttagagggccgcggcctgattcctagtgattttgcagatgttgacggacacttagcttaccaagttggtgaagatgcgcaccaaattgcgtatgaccaaattgcgcgtgagtggaccatcacgatccgttaaggtagattgagagagaatagagtcttatattggagcgatattgattgagcacaacaaattcccaagcaagtgcagataatgatcagcttttgccagcacccccggaacttttgcaagctgttgatcagttgaaagcttattcgttacgttatgaagttgcgatgaagctcgttttagataagttagattatattagtcgagagtatgagcttcgttacggctacgcgttaattgatagcaagcagtcccggatcaagtcgcctgagagcattgttggtaagatgcaacgtaagcatttaccgttaacgttaaatgcggtgtttaataatttgcatgatattgcgggtatccggttgattgttcgtttcctaagcgatgtcaagacagtcgagaatttattggcgactcaggctgacattaaagtattacgagtgaaggattatattcatcatcctaaagctaatggctatcagagtttgcatttaatcctcggggtgccggtctacactgttgatgggccgagcatcattgaggtcgaactacaagtacggacgattgccatgaacttttgggcgtcgttggagcatgaattaaattataagaagaacgttccgcatcaggacgcattgcgagcgtcattgactaagaaggcgcagttaattacggagctggatcaggaaatggacgatatcaagcaacggatgtatgaacctaagacgcccccaaaagaagtctaaaaaatgcccgattattagcaggtaattgctaataatcgggcattttggggttttcttgatgcgaatcaagtccacccatgcacatgactggtatcttattatagaagaaagtaattaagaagttagattgcttttgcaattaaagggttcatgttacttttaataggcaagataatttccaaggcatattgataataattaatttaatgggaatagctagattaattaaactaacaatcgaatagtggggttaaattcagtgttcagccaaatttttgactggttttcctcggtaccaccagtcgttgataaaactggccagttcttccggtgattcatgtagtcctgtttttaaccaataacggacaacaccaacgataccattgagataatactcaaacatgtactctttttcgcgattgccaataccagtgatctcagcttggttatgtgctaagatctcacgcttagttgttgcgataaagctcatcagaaaatcctggtcggttgttaagatgaaggaagtaacggcgtggcgtttcttaaccacctcaaaaattcccgtcagaatggcttgtaaagagtcgggattaagatgtttatcaataacagctagcagttcttccgtggcatcttgttccatcttctgcatgcaatctttgacgtcttcataatgggcgtaaaaggtgccccggttgatatctgcggccttgcagacagcagtgaccgtaatctcatctagcgactgatgttggagtaagttgattagactatcttgaattaggcgttcggtcatttgcgaacgacggttgtttttagtacctaccactgaagttcacctcattatttgaacaatatactattgtttgtttatttaatgacgattttatgaaaattgttggttgaaattacaccggttttcatttaacatgttgttattatttaaacacattgttgattaaatgtcacgatgtcgttttgagaatctgaattagggaagggatataacgtgaaagggagccgtagacgttttacaatccaagcgattgtttggctagttgtgatggtagcggccatcatcttcctgccaaatatcagcagtctggtacgtgataagggccagaccaagttgccaagtagtgctaaaagtcaagtcgcacaagtcattcagaatcattgggggcgtaatcaaaataatacgcgccaagtggtggtggtcttcaataatggtgattcaccgttaacgagtgaccagaagcaagcaatcgatgggacgattcaacgcttcaaagtgcaaaaatcaaaatatcacgtgaaatcaatgacggctgccagtgataatgctgctgccaaaaagcaattgatttcaaaagacaaatccacccaattactacaattaatggttggtaagaaccagaccgtcgcgaacatgaccaagaatattacggctggtgccaaaacggctggggttaagacgtacgtgacggggagtgacatcttaaatgatgacttcactcaggaaacggaagcggggattcagaagactgaaattattaccgttattttcattttcatcgtgttaacgttagtcttccgctcgccgattacgccgttagtttcactgttgtcagttggggtgtcgttcattatctcgctgagcgttgtgatgaacctcgttaataaatttaactttccattgtcgaactttacccaagtctttatggtcgtggtcttgttcgggattgggaccgactacaatattctactgttcgatcaattcaaagaagaactcagtcatggcgatagtccggtcgccgcgactgggcgcgcgttaaagattgccggacgaacgatcctatacagtggatcgtcactattgattgggtttagtgccctcgggttagcgaacttctcaatttacaagtcagcggttggggttgccattgcggttgctatcctgttgctcgtcttgttaacgttgaatccattcttcatggcgttattaggaccacggttattctggccaacgaagaagtttgctggcggtagtacgagcaagatgtggcacggcattgcagcgtcatcagttcgttacccaatcatcgccctagtcgttgttttgggtgtctcattaccgtttatcctaacgtacaataatgaattaaactacgatacgttagctgaattaaacgacacgattcctgcgaagaaagggttccaagttgttcaggatcacttctccaaggggacggctgaaccgtcaacgttatatatcaagacggatcatgccttaaacaatgaaaaagatctaaaagtcattgacagcttaacgaagcagttacaaaaagttaagggtgttaaaaccgtggcgtctgtcacccaacccggtggctcacaaatcgatcaattatacgttggcaaccaattaggcaccgtcactagtgggatgaagtctgctagcaaagggctaactaagattggtagtgggttagatagcgccaatagtaaattgaagagtgccgatatgtcggatagcgcgaagtcggccaagaagttggcagatggggcggatgaagttgctagcggtgttgtttcatataccgatggcgtctacactgttaacaatggtttgaaccaattgaatagtaagaccgggactttgtctagtggtgttaatcagttggtcagtggttcagggcaagttactagtggattgaacacgttgaacagtaagactggtacattagcaagtggtaccagtaaattagcaagtggtgcaagtagccttcaatcaggtttaacaacttatgcgaatggcgtttatgctgtaaataaaggggctaatcagctcaataattcaactagttctttgcagtccaaggtaggccaattgctaacagggactaactcactatatagtggacttgataagttgaatagtaagagtagccagttggcaacgggtgctactactgtagataatggtgtatctcagttgcaaacaggtgctcagacactagctcaaagcttgtcgaagatgcagacaaccctaaatacaagtaattctcaagctaataaagctaatattaataagttgacaacagggcttagttctttaaatacgaatatggctgcattagaaaagttggctggtggtatgtcaggaacaatcagtggtgtgcaaaatgctggaacagtttttaaaactgtgtcgcctaagattaatactgagatggggacgattcatagtgctttgcaggattattcaaaactagaaagtgcgtataagcaggatcatcagtcttcaagttcttctgttgatgctaacgcaattgcctcagcagcggttgccgcagctggttcttcagtaacggctgatcagaaatcagcgattagttctgcagtgtcatcacaagtcaatgcgcaaactagcagtactagcacgtctactgcaacaacagtagttacttcaactgatgcggcaacaggtttggcagcatgggagacattaagctcacaattgagtgaattgcaagcggctattgaaaaattagacaattccactggagatttatctaagttaagtggtctgtcagaactggcttctcaatcacaagatgctaatagtaaagccattaagacaatcaatcaattggaatctggtattactcaaattcaggaagcacttgctggaagtactactagtctgggccttgttagtggttccaatagtttgacagagagtttggcaacattaaaggctgggactagcgaattggcctctggcttgaatgaatatacaaatggcgtttcaactgctactacaggcgcaagcactatcaataatggtgttggaaccttaaacagttcaataccaaccttgacaagtgctatcagtgctattagcagtggtactagtcaattggcaactaacacgccaacactaactagtggtgctactcaattagcatctggtactaatgaactcaatagtcaagtaccgacactagttaatggtgttcagaaattggcttccggttcatctcaagtaacaactggcttaactaccttgaaaggccaagtaccaacgttagttagtgcaattagcgcgttagatgctgggacgaacaagttagttgctaattctgcaacccttaacagtggtgcctcgcaagtggcctctggtaatgaacaaatgtacaccagtatccaaagcttagtaggtcagatgcagacgctccaagatggtttgaagactgccagcgacggaactaagacaatcaacactggtgttggctcagctaacagttacttgactggcttaaaggattccgcggctgcgaagacgtattacgtgccaaagagcactttgaagggtaagacttacaagtctgctttgaaggcttatatgtctggtaacaaccacgcaacgaagttaacaatcgtcttgaatgaaaatccaagttcgaagtcagcgatggataaagtaacggcaattcaaaagcaagcgacgaatagcttgaagggaactgcgttagatggtgccaccattgcgattggtggtcaaacgtctgaaacgaacgatacccaagcaattgcttctagtgacttcgttcggaccgctgcaattatgttagtcggaatcctgattgccttgatggttatcacacgttctgtcttacaaccgttctacatcttagggactttgttattggcttacattatgtccttgagtattacacggatcttgagcaactggttcttgggtcaaagcatgttaacttggaacacaccgttcttcgggttcatcatgttgattgcgcttggggtcgactacagtatcttcttgatgatgaagtatcgtgaatttgataattcggctgcgacaccaagtactcgaattgtcagagcttccgctgtcattggggccgtggtcttatccgctgccttgatcttgagtgggacgttcgcagccttgatgccatccggtgtcttgacgttgattcaagtggcgatggttgtgattatcgggttgattattctggtattcgccatcccaacgattattccaagtttgattcgcttaacttatccgttgacggatcgtatggaagacgaaaccactgctgaaaagcagacgaaacgaaatcgtcaataaaataagtcagttatgcgataataagtgtaaccaactggcgccgtctaacgattcaagttggacggcgctttttttaggggctgcacttagattttaaaaacagtgttagttttagtctaagagtatgcggcgagtatgagatagccggattggatagtggcgataaggagatgtttttaatgcaacgatgtgcatgggcggattcatcaccagcaatgcaagcgtatcatgataacgaatgggggcggccgcaacataatcagcaacgactttttgaactgttgtgcttggagacttatcaagcaggactgagctggcagaccgtcctgaataagcgggcggcttttaatgaagattttgcggattacgatgttgaccaggtggccgctatgacgaccgccgatgttgagcgactactaaccgatgctcgaattattcggcatcgccagaagttaatggcaacgatcaacaatgctcgtgtgatccgagattggccggccggggaagattttgccacttggttatgggcgtttgttgataaccagcctatacgccaggcgtggacgtcaatcgatgaggttccggcaacaaacgacttggcgcaacaagtgtctaaagagatgaaacgccgcggcttcaagtttgtcgggccgacaaccatttattcttatcttcaagcgactggtctcattaatgatcatgtggcggactgcccatttgctccagaaaatttaccggcctaacgcgcttaattcctggcgcggtgagtaagtgagccgtcaatttaaaaccagcgcgatgacaactgtcaggcgctggtttttattaaaatcaatatgttttgatataagtgcgattgcttaaattttatgtataaataaatacttattataaccataaaaacaattgacatgatgtcgcttaatttgctaagatacggcgtaagaatagctgcggaaggcaagtgatgggagcgacgttaggtgaaagaagtaaggttttggggactcttgttaggactgtttgtctgtttaggggcagtgataccgttagttagtaaggctgacgtacttgatacggcacccgctggactgaatctggaaggcttatttgaaccgggaaaatttgaccgtaattcggccacaatgcagactgtttcaaagaatggccattcgcagcatgttatcgaattaacaaatgacgataatcaagttggggcaatgtggtcgacccctgttaatcgctttaacatgcgggtcgataaccaagtctcaatgtgggtgaactttggggacaaagccgtgagtgaaggactggccgttgttttacagaatgatccccgcaaaatgagtgcgattagtcggtatggaaagaaaagcattattggtgagaacttgggtgtttatgggacggatacctatacacggcgaacggcgccggccacgattgctaagacggcgattcaaaaaagttgggcgttggagctggataccaaagtgaatgacggtggtttttggggattgtatccccgggggaattctttcgatgaaaagcctaaaaaaatgcatatggccgcgagctaccctgcaagtccggatacttatacgcaacggggtggtttaacgtcctcttatcgttttgaacagaaccatgggagtatcgctgataaattaccactcgcggacggtaactggcaccatcttgtattgaagtgggtcgccagtaaacaaatcatgagttataccctggatcagggaccaacacgaatgaccacaattgatacaacagtctttggaaaggatatccggaatgttacttgggggttaactagtacggcgacaaccgctaatgccagaacactggtcgtctttgaccggttgccacaaccgattgaaatcgagtcagatttaaacgtaaccaatctgactcaagagcgaactgtccatgaaggagactgggttcatggtggggatgagttggaatatgagtacgttctgagctatctcaatggtgacaatgaatggcaacaggttaaggccagcctaccattacccgaacaagttcactttagtcacgcgaagatccgctatgcggatggtaccgaggaagagatcaatttaccagcggacgataacgaatcgtcggtggcccgcttacaacacgatttgcagcggacactatcaatgaaaaatccgcacgcttatattacgctgattggtgaggctgccaaggtcgatcgggatacttttgttgatgatgacatgagttactttgagggtcacgagatgaagaccgcaacggccacaccgcacttcaccattacgaccaataagaccgttaacctgacaattgaaccgttgacacaagtgaagaaaggcgatcccgtcatcattaagggccaaattaagctaaatgatgggttagactttgacaatgatggcatgcgtatcgagtaccgggtcaatggtgaagcgggagaagactatcagttgagcatggacgatccggttggttatgtcgaatttgaagtggatgccgaagaactacaaatcggtgaaaatcagattacgttacgggctcatagcaaagataacgcctactcagaaccagtgacagtaacggtcacggtcattggtggggagttacagctgaaaaaagtcagtactgaaagtgtgtttgcaccaatcaagctgacgggaacggctcaagtcagtcggcccgagggacttgaagtagttgtcaatgatgatacgggctcgaaagctgcttggcgcttagaggcgaccgcgacccctctcgtgactaatcagggccgcacactagcgggaaacttgtattatcaggatggtgccaagctgacaatgttgggaaaggatgccgtggaaatcgcgcgccaaaagacggccccggggatcgactatgacgtgaccgcccactggtcatcgcaacaaggtttggtgctcaaaacaacgcccgccgctgttcctggaagttatcagggtacgatcacgtggcacttaagtaccgtaccggaagagtgagtttacgattgtgtaagtaattcgtttaatcaataagttcaatagtcgcgacaagaattaattgctaattcttgtcgcgactatttggcgttcagcgaaagtgctgactaacgcatttaaacgggcctccgatacggtgcaatgctagtagtagcaagcacaaccagcctttcaggggcttagctagcaaattgaaaaatcttcggtttcagacccataaataaacccagcaagttcacaaattagtcagatttcccgtgtaggttaaaagcagtgcaaagcaattgtcataccaatactttatctgaaggagggtttaagcgtgaatttttttaaacgcgcatggctcaatctaacggcaaaaaaaggccgttcaattctattagtacttgttacatcagcaatcatgctgtttgtattggccgggttattgattaggaatgctgccgatacggcaactagtaatgccaagaaaagtgtcggggcgaccgtcactttatctgctaaccgggaggcggcttttaagaagatgcgcagcgccacgtcgacgagtaaaagtagtcggcctaagttgacgacatcgcccgttaaactgagtgttgcgaagaaaatcgccaagcttagcaacgtttcaagttacaatgcgaccgtctcaacttccgctaatgcgaagggctttgatacgatttcaacatcaggtagtagtactggtggtgggatgaaaggtatgggtggctcaagtagcagtggtactggtgatatctcgattactggggtcactaatacgagcagcgtctcaacctttgaaagtagctcaagtaaaattacgaagggccgcggtattacagctagtgatgaaggcactaacaacgttgtcatcgaaagtgaattggctaaggaagatagcctgagcgtcggtgatacgattaagttaaaagcaacgaccggtgataagaagacttacacgatgaagatcgttgggatctataaagcgtcgtctagtgcaagtacgcaacaaggtcctggtagtaccgatgtcagcaacagtgtttacacgtcatacacgttcgctaacacggtcaagggttctaagtacaagaacacagctgattctgtgacttttgcaatctcagaccccgctaaagttagcagcgtcaaaacgtctggcaaacagttgatcaatacgtcgaagtattcgttgtcaacggatgatagcagttaccaaacggttaagagttcgatgaataacgttaaatcatttgcggataagattgtctggctcgttgcgattgctggaacgattatcttagctttaatcgttatcttgatgattcgtgaacgccgctatgaaattggtgtcttgttatcattaggtgagagccgttggaagattgtcgctcaattctttgctgaaatggtgatggtcttgatcgtctcagttgtcttagccggattcggtggtaagtttgttggtaataagctgggtgaccagttagtttcacaacaaacgacgactgcaacgactacgacgagttcaactagtcagcagggtcagcctggtggcggtggcggcgcccctagtggtaacactggtggtagcaagccaagcggcaatatgcctagtggtggcggtcagactggtaatgccagtgccacgaccgacacgaacttagatattaatgtcacggtaatggatttagttgaactcggcggctttggcttagccatcatgttcctgtcgattatgctggcttctggtggcatactacgactacagccgaagaaagttttaattgattaggaggggcggcaatgttaaaagtaaatgatcttggttactggtatgaccgccaagaaaatagtctatttgagaatgtaaaccttgaatttaagtcggggacttcgtatgccattgttggtcaaagtggttccggtaagacgaccttcctctcactgctggcgggtctagataaaccgcgggctgggcaaattgaactcaatggtgaaccaatcaataagattggtctgacgaactatcggaagtccaaagtggcaatcgtttttcaatcatataatttgttgacgtatatgtcaccattgaataatctgatgactgccatggcaattacgaactcggaacaccgtggtgacaaggattatgcgatgaagatgttacgacggttaggtattacagatgatcagatgaagaagaatgttcaacgcttatctggtggtcagcagcaacgggtggcgattgcacggaccatggtgtgcgatgctaaactagtggttgcggatgaaccaaccggtaatttggatgaagaaaatacgaaatatgtgattgaccaatttcaaaaaattgcgcatgaacaaaagaagtgcgtcattattgtcacgcatgaaccggatgttgcggacgtttgtgaccactcctaccgattagaaaagcacaaatttgtggcggaaacctagggtgctcttacgattgaatcagacgtgagttgacgcgtacaatcgcatttttgtcaagataagtcactaaaaatgagttctcagaatgatttgattctggggactcattttttgattactgtgaattgctaacgagacaacaatcgtttttgagggcgaacttgccagcgaacgataaaggcgatgatgataaacaagacgagatagagcaccgagatgccaatcgcgtaagcaaccggaatactcaacttggccgcggtgtgggtatgcgtggccaaactaacgacgacggatacgtccgataaggcgtgcaagaaaatcggccagactaagttattggttcgtagataaaggccgcaaaaaatcaggccacccgctgcagcataaaagacttgtgggatgacgtagctgagggtcagctggctgctgttaatgagtaggtgggtaagaccaaatagtaaactgtcgatacaaatggctagcatgagtcggtgagggaagcattgtcgtagtagtggcaggagcatgccccgatagatatattcctcagtgatcccgataactagggcgtagccaatatagagaattaacgttggggtccaagcaagatgacatagcttgatgaagttgctcgtcattggtagtaataaaataatgattcccgggatgagctgcaagcattgtcgtacgagtgattgcgattgccaccactgaatcgatattttaaaccaaaaatgatttaatagcaggaaaataagtaatacaagcaagtcttggaccagcccactgtataaagttggtactggtagccaggcaattaatttaaaaagaattggtactaaaatgaaaatactaatagcggctccccagccgcgtttggttgatgacatcgaaatcccctccagaagttaatgctaactttagtataggtcacattgaaggtgttggttatattaattacggatcgattagttgccggtggtcattatgacagccactggtgattttggcgtagaatcggcagtattaataggataatgaccgcgatttcgatgatttgaaaactagtcgtcgttataccgggcaaattgattggaggttccatcatgctaaagaagtcattgacggtgtgaatcaacaatggccatagtagcgatgttgtctgtgccgtgattaaacataatagtagccccagtacgaacgtaaagcccaattgcaatagggttaaactaagtgtttggtgaccaagattgattagatgggtcaaactgaagaggatactagtgaagactgcagctctacctacacccaatgttgactggctggcctgaaacaacattccgcgaaaaaaggtctcttcgaacaggctgatcaatatggcaacgaataacagggtcagggtgtttgtcagttgttgggcggttgctaacgtatataatccaattagtgcggctacgattaaggttggaatgatgggccggatttgccgacgccaagttgccgataccccaaattttaaggtttgccgtagccagtcacgatttaatatgagtgcaattgctaaaaagaacagctcttcgaccccagttgttaatgaggatgggagttgggttaagcgtggtagctggaaaatcaggccaatcaacaacatactgcctaacatgccaccccatagtgtgatgactaatttggtttcgtggcgcatctcctcagatccttcctcgtattctcgctactaagcatacgccttttaaatgaatctgagcataaaaaaacagcgtaacgacaattaatgtcattacgctgttcgttagtaatcagttattttataaagcccaagcagccatgccttgtgcgttgtataagctaacggcagcgttaacttggtcttcaacagagccactgctgatgtgcatgttttggaataaaccataggcaccagaagtactgttcttgaccgttgagttccagtttgattcacgcgtgatgatcgtgttccaagttgaagctgaaacgccagtccgtgattgcatttggcttaatacgtagctctttaagttactaccagtgtagcttgaagtcgttgaggttgttgaagctgttgatgatgcagctgagctagtagcacttgataaagcttgactagtggttgcagcagaacttgaagcttggctagcagctgattgcgttgagcctgctgaagaagcagcactcgttgcaacgcttgaagtagcttggctagcagctgaagaagtagcagcagaactagtagcnnnnnnnnnnttcgtgcacgaatgcctgataggaggcgttcatgtccatgatgacgcttgaaccgcggcccgttctgcggtgctgtactgactaagaaagaactgtttgatggttctattaaggcggtcgctaagtactttaactgatttgtgagtgtcggcgtcaatgcaaataaacgacatggagccgtgcgtggaacggaattcaccaaagcatagattaatcggtaaccggcggctcgcgtgtggatgaatattagccgtcaaaatacgctgaactgagtttgtcgaaataccggtgagactggcgatagtcttagccgggagtgatttactggctagcttcagcacatgagtcgctagcccgtgaccgatggcggagttggttgataccactggagtggtggccatacaagtgctatggcagttactacaacgccagcgttgcttgtttagctctagaattacgggccggtccatgggtcctgcaaggtggatatgagtgagcttgtgtccgttagggtgcaacgtattgtatccacagctgggacagcgcctgagtgtgtaggtaagctctgcctggatgaccaaatactttttgcgacccgagccccgaccatgaaattcctcacgagtaccgaacacctgaatgtttgtgtctgtaattcccagtaatttaagtgtattatctagttgagacatctattcctaccccgcttatcttgagtttcgtcgcttaaagcatagcactagggaggcttagatgcctttttttgttatcaaaaagggcctagtacttttggaatggaaatactttccaacaccaaaaattctagacccaaaaaaagattgcgaatcagaaatgatccgcaatctttgcatttatttattaatttaaagtggctttttagtaccagccattagcaagccagtgactcttggcgttgctccatgaaccataacgtgaagcaacataactgttagcaacacgttcttggttggcagcggagtagtcaccgtttaagtatgaagcacttaattggtatttaccgatgtattgaccgttacgagcagaatatgaaccaccagattctttaccagcaatccaagccttagcagcactatcagaaccattgttgctatagtttgatgttgaactagacgtttgagtcatcgtctgagcagcaggtttgctagtttgtgtttgacttgattgggtctggctagcttggctcggttgagcttgagtttgactagtctgagctgatgattgtgtcgtggtcgtttgttgagtcgtctgtgttgaagtnnnnnnnnnnttgagtcgtctgtgttgaagttgaagtcgtggtagtgctatcaccatttacttcaagttgttgaccaactaagatcaagttaacgtcttttaagtggttagcttgttggatcgcatcaatcgtcgtgttatgatcagcagcaatggcagaaaccgtgtcaccggctttaacagttaccgtagcagcttgagcggtagcaccaatggcaaagagactagcagtagcggcagcagttgataataaagcattcttaatcttcatttgtaatgtacactcctattttttagtccgaatttggcttggccccgcgaatcttccaagcactcaatggtacctagtataactggcgattgtgacaggaaaatagcaggagttttacgaattaccctaattcttgtaataaacggcgtgttttgtaatcttttgtaatataacgcgcggcgcaattgtttctgagcgggtcaatcaaggctgtttacaaatgaagacggtgtctgttggttaacataaccaaatgttgtgattaaagttcgaagcgtgatatcactgggactggcaaccgctgatgtcgtgactaagcttagttaagccaatttacgagttcttttagtggaaatgtaagcgtttgtttgaatgtcagccaacttacttttggtaactcgaaattagtcggcctttaattggaccagccagttgtcggtttgtttattgttaatgagcgattggggtgccgcttgtaggtctttgttaagcttctgaacggtgccactaaagggtgttgacaccagatgcgccccttgatcgtccgtaatcgtgacgagcggatcacctgccacgaggtgctggcccttagttggtaaatcgagttgatgaacgacacccagattgtgttgtccttggtcacttaaccccagtagaagccggtcatgtgatttggtcttcagccaaacgtcgccgtataacatcggagcatgttgctcttcgtaatcatgacgatagaaatggatcatttgtttccaagcagattcttgttttgccatcatttctcctcaattcagtgctagtagtcggtgcatcaattgaaagtggtgcatgattgctaatttcttaattattcctaaccctgggaatttatcaccctcagcgtaggccaatagggtggcaagcgcgggggtgcgattgagtcccgtcaggtgtgcgggtgcccagtcggtgagctttgttaatgcttcaaaaaacttttgcttttgaccacgcatattggcattgctgtccgaaacaaaatgatggatgcgcaggtcaccgttaaccgtaacataaataagatgtaatgcaattgcgcgtgatggcataccgtggtcaaaatagggtcggcccatgagtgagtaatcgccaaaaccatcaaagccaaccggtgtttggtgccagttagcgggggcaaaataggcgtcagttatttcttgatagtccgcaacgtgcgctggggttgccacgggatcagtcaataagaccgcgtgttgtggtaatagttggtgcaaacgcgcttcatcagggattaggacatgaccagcatgctgtaaagtggtcgtatgctgataggccttaagcaacggatagttaggcgcgatgagcaagcttgtttgaccaggagtggttgtcagaaagtcgcgactaaaatcagccgcaagaattgcgcccggccggtaaaatgggtagggacgcagatccggaagtggatggagcttaacggtattaagaccatagacactcacttggggattcgcaataatgctaaatggttgttgggcttcaataaaagtcgtgactatttgttgtaattctttggagtcacggactggttcaattactgggatgatgtgtgggccaagttggtgttgctcgcacaatgttcttaaggctaacaaatcatacatccgtccacgtagataggggtagtaagtgctcataactggtcacgcagatctggtgccgttagcgcctgatattttagtttgagtgtctgatattcggcattgcgggcatctaattctgtttgtagcgcagtcaccgcgtcattctgggtgtcatcgatgaagcgatcgtacaagttttgttcaggatcataaacgtcgtagccggtgctggcccgtttgcgtaattctttgaagagttgatcatcagagtagagctgtagtcctttcttcacacgcttggctttatcgacctcacgaaagagcgatgtgataaagtgactgataaggggcgtttgctcgacttgtaagtcttggcgttgggctttcttagcgacagttaggaaaccaggcgttcgcaacggttggggtgcgagctctagggcccgctgatcaaaagcacggtagatcaatacaccaatatggtctggaatttccgattgaacttctaggtaaagttgttgcggcaagacaaagtaattgtaatgaccgataaatgaaagtttggcctttgaatgaaaatctgctttggtgactttcaattcgtagcaacgccattcaatctgaccatcggggagttgttgatagcttaatgtatcaacgatccctttatcagcgggcatcgcaacttcttcaaccacgtaggcgccctgttctagacagtactgatagagagtactttcaagttgtttagttaatttagtcttcattaatgagtcacctccatttggtgccaaaagttggcaatcgttgcttcgagctgcgggactgattggatcgtctgatagtactgccaatgtgctggaaataaatctgtgtagcgccgactagcgaagcgttggtctaacaagagaacgattccggtgtccttggcactgcggatcaggcggccagcagcctgtaagacgttgttcatgcctggcagttggtaagcgtaggcgaatcctaagccgttttgatggtcgtagtagtcacgaatcaagttcgtttcagggttgatacccggcagaccgacactgacgatagcgactccaatcaaacggtcgccacgtaagtcaatgccttcggagaagataccacccagtacgcagaaaccgagtaaggtttgcgagggggctgactgaaactggttcaaaaaggtctgccgggcagttgcatccatcgtcgaggcttgggcggtagttgccacatcagggtaggcggcttcaaaggcagttttgatctgcagcagatagccatacgacggaaagaacacgaggtagttgccatgtttagccgtcaacatggcgtgcaagctggcaataatccggggcacgttatgttcgcgttcgtgatacgttgtctggacgtactgggtgacgagaatggcctgatgctttggtggaaatggtgatggaagctggtaggccaaactgttggcttcaccgccaagcacccgctggtagtaagccatcggggtcagcgtcgcagaaaataggacagcaccactgccgagctctaatgaccgattaagaaagtcactgggatctaggcagagttccttgatcgttaagtgatgaccgtcaaggacgaagcgcgtctggtagctgccatcatataggtcgccaattttaacaaaggtcagacagacgaagaaataatcacggacggcgtcgagcagtggccccggcttttgttgcgccaaccagtcagtcacaaattcattaaatgttctgagggtgcgtaataatttgtccgggggatcaggtagcacctgttccgttacttggtcatcaatcaaggttttactgatgcgcgtaaaactacgccggactttcttgagttcgcgttgtaagtcgtcacttggctgacttttatcgggcttggctaattttagcaacgcactgattggctggtcactaacggctgcagagtacatatcacgggagcgactaacaaggttgtggacttcatcgataaggaaaaagttgtcgtcatcacgttcgctaaagaatcgttgtaaatagactaatgggtcaaaaagatagttgtagtcacaaataatcacatcacagaagagcgacgtgtcgagtgaaaattcaaacggatcgacagtatgcttgcgagcatactgttcaatcacggaacgggtaatctggtcttcatgggtcaacagatccttgagtgctggtttaagtcggtcgtagtagccaatcatataaggattatcttccggaagtacatcttgttcctcgggaaaccgaatctgatccttggcagttagcgtaatgcttttcagtttgagtccgtcatgactcattagcgtgaccgcttcttcagcaacgtggcgcgtactttgcttagcggtcaggtaaaagaggcgctcaatcacgtcttcgcccattgctttgatagccggaaatagcgttgagatcgttttccccgtcccagttggtgcttcgacaaagaggcgtttttgcaaccgaattgtcttataaacagcgccagccaattcatgttggcccggccgaaaagctggaaacggaaatggcaagtcttcaatagaagcgtttcgttgtcgtcgtaaatcggctcgtaatgtcaaccagtattcatattctgtaattaagtcgtggaagaatgcgtctagttcagcccggtgaaggatttgctgggtcttcgtgattttttcattgatgacttgaaagtaggtcagctgcaacgtgacctgctcaagatcgggatgttcttgcagtaacaggtaaccgtagactttgatctgcccccagtaaagtgtcaacgtgttggtacttaagttctcgaagacttgatcggatgttttgatttcttcaatcaacgccccatcatcatttaactgaatcccgtctgcccgacccgcgataatgtaatcagtatcgttcatcgtcacaatttttttcaggtaaacttcgctatcatagtcttcaccacgactactctggagctgacgatgaatcttagcaccgttcaacgcagtgttctggctattctttacttcatttaaatcgccttgtcgcaagacgaattctaccaattgtcgaattccaatcttagttgccatcggagcatcccttctgaatttagtcgcttcctattataaaacatctgttcgtgtttgtctgctgttgattgatgatgccgggcggggctctgtgatgtggccttaaatgatggttaagctgcggcagaccaatatttaagacgcgggcttcggcggcttgaatctgggctcgtcgtgttccagcaattggcgaaaatgcctgggagtcaatgtaggacgaactagccagacgggtgcatgctattccgaattttttccagcgaatcttagctggtcacttttgcctttgaaaaactgatacgggttaacaatctggattgaaagctaaataaaaaagcatcgcgataagggcgccgatgcctgttgcgatgtttagattgacgattttgatttagaagaaaatgaatcagactaggaagttaatcgtaccaatggctgtggtgttggcgaatgctcttgcggagactaaaaccgtagctgatgatgccggctgtgataatggtcgctaaaatcgcaagcaaccatgaaccggacgtgctaaagtaggtggcgtaaccaaggctgagactgactaatgtgatgacgggaattagaattctcacaggggctggatgtaagaagacgacaccggctagccacagagccgctgctgtgaccatggcgtcgacactgattggtgaaccaaagctaataccaagagtgatgatagcaagaattgttcccacggtcaggaggaggacagcaaagccgttgctgacggaccaagtaaacgtttttttcatcatgatcgcctcactttctattaactatattataggctaatttcgccttatgaaagaaataatatgccgacaattaagtttgcaatgttatgaaaattgaaagtttgtgaacaaatccttgaaagcgtatccactattagttaaactggcattaggcacacttgatgatggatggaggaaaaatagtcatggcaaaaattttagcaattaacgccggcagttcaactttaaaatggaagcttttcagtgttcccgaagaaacggtaatcgcatcgggaatggttgatcggctgggattgccagattccgttttcacaattaagaaggcggatggtagtaaatattctgaaactaaggaccgaattgatgcaaaagaagccgctgcaatggtcttaacacggctgaagagcgataatattgtgactcatcttagtgaaatcactggggttggtcatcgggttgttgcgggtggcgaagatttcaaagactctgtcgttattacctcgcaaaccttgaaaaaaatcaaagatttatctgagtatgcgccgctacataatccaacgcaggcttattatattgaagtattccgtgatttattaccaaaagcgactcaagtagccgtgtttgacacttcgctgtatgcggatatgcctaaagttaattacctatatagtattccttacgattattatgagaaatttggcgcgcggaagtatggggcacatggcacaagtcatcgttacgttgctaatcggacggcccaactattggggaaaccattggattcgcttaaattagtgacattacatttagggtcgggtgcttcgatcacggcttttgatcatggtaaagccgtcgacacttcaatgggctttacgccgctagctgggattaccatgagtacccgttccggtgatattgatgcctcaattattccattcttgatgcgccatttagggatctctgatgtggaagactttgttgatattttgaatcataagtcagggttacttggtatttcaggtttgtcacctgatatgcgtgatcttgataagacgcaagatacccgtgaacggtcaaaactagcaattgatatttttgttaaccgggttgtgaagtatgtcggcagctatattgctgaaatgaacggaattgatgcccttgtcttcacggctggtgtgggtgaaaactcatggatgatccgcgaacgcgtcactaaagctttaggatactttggcgtgacagtggatgatgaaaagaatcatatgcacggtaaggaacaaattattagcaaagatgacgaaccggtaacggtcatggttgtcccaactaatgaagagttgatgattgtgcgtgacgttgaacggttatctaaagctgaataaatgagtcaattaaaaacgcgtgattcggattgtggtccgagtcacgcgttttgagttttggattctaatcagcatagcgctaagtcagctcttgtccccgcatatgtgccgatgtgatgtgctcagctattggcgttgtcgcgcaggtttagtcattttgatgtggggcgtgtggttgaatagaaaaggggtaccgctcgaagtgaagccgaaatgctggtaaaatctttgtactggcacttgggcttcaatttgaattggcaaatcagcatagtgttcctgtacgacctgttcgatatgggccattaaatcagcgcccaagtgttgtccgcgttggtttttgtccaccacgacccggccgaaggagagatggtcatcttctgtaaagattcatgcgtatgcaacaatattttgattgacggttttaaagacatgataagcttttaaatcagtatcatcgacttcctgatagatgcgctgttgttcaacaacaaacgttttgacgcgcaattcataaatagcgtataattcagttgttgttagttctgagaatgttttaatcgaccacatggtgatgcctccttagcatagtgctaagtttatcatcaaatgattgcatatgcaataataaaaaggagcttctatgataccaacattaagattgatgggcacgttgtcgcgaatcgtcacgaacgagggtaatcaacgttttgcgaaatacggcctcaataacaatcagtttatttatttaattcgaatttgtgagcagcctggcctattttttagtcaattggctgaccaaatgaagatggatcgaaccacgaattatcgcgccgttcagaacttaataaaaaaaggttacgtgattaagcagacacatccagagaataaaaaggtccggtgtttgtacccaacgagcgctgggcaagcgttgtacccggaattgcatgcttatgagcagtggtgtgcagacttggttggtgagcagttaacgccgggccaacaacaagttttgtttgaaagtctgtcgttagtcacggctaatgtcacccagcatattgagtaagtttaatcactaaactagattaattgtgaacaattaaaatggcgtggcgttttagctgaattttaggcgtgaagagtgtaccatgtagttatcaagttataactggattaatgtgatcaacgcaggttagcacaattgctggacaggcggcattagtcaacaggaataatgaaaggggttaataaatcatggcaacaactttggtgttaggtgggggttacgcagggatgcgagccgtcaagtttttacagaagagtctaccaactgaggatgaaatcattcttgttgatcagacaccgacgcatacggagaagactaatttacacgaagtcgcagcggggacgatcgcacctgatcgaattacttatcagattccagatattatcggtaagcgggtccagttcgttcaagcaacggtcaagagcgttgatattgaacaaaaacaagtgacctttgaagatcatcctgaaatgacctatgactacttagtattagcattgggcttccagtcagaaacatttggggtagctggcgccgatgaaaatgccttgccaatggatgatttggcaacttcacaggctgtttatgaacatttggaagaacggtttaaagcctaccgtaccagtaaggacaaaaatgatttgaagattgcggtctgtggtgctgggttcactggaatcgaattattaggtgaactgacccagacgttaccaagattgcaggcgaagtatcaaacacctgctgctaagttagtttgtttggaacggatgccatcaattttaccgatgtttacgcaggaattgcgggactacgctttgaagtttatggaaaagaataatgtcgaaatgcggttaggtgccgttattgaggccatcaaaccgggtgctgtggtttacagtgacgcggacaagaacgaacatgaatttacggctaacactattatttggacggttggtgtcagtggttcacacgtcattgctgattccggttttgatcagcgccgtaaccgggtcgtagttaagcccgacttatcactggaagggcatcccgaagtattcattgttggggatgtcgctgcagtgatggatcccgaaagcaatcggccatatccaaccacagctcaaattgcactggcagctggcgaacaagctgccaagaatattggcgctttgcgtcataaccaagcaacggcgacgttccactatgaatctagtgggaccgtggcctcattgagcgatcgtgacggtattggtgaaatcttcagtagtaacaaaccggttcatggctacgcggcatcagcattgaagaaaattattactgaccgctcacttttggaaagtgcgcatttaggaacggtcttcagtaaagggcgttttgacttatatcattaatcattaaattaattccagtagtatgataaatagccaccacagaaatcgaatttctgtggtggctattttggactagttaaccgtcgaatggctcagctggttgctgattcgggcaattaagtaaccagctgttgggactaacgatactttacgggcaccccttacaattaaggcatgataagggggcggtcaaaatgacgactaaatcaatacgaacaccaattcaaccgtggtttaccctagtggtagcgggcagcttactgataaccttgttttctaccgcactttggtggttggctagcagtgcgttttgcgcgttactcattttaaacttacaatttatcgtctttccaaccaccgcggatcgttattggctaaatcggctcagtttaggattggtactagtgctagtagtgctcgcgaatattaaatttttaatcattagtggcttgacatggcagtaagcgcctagacattaaaggacctgacttgaagcactctgtttcaagtcaggtccttttgtctaatgatgccagtcatttgaatcaagtaggctgatccgattagtgatgcatcttaaattccaaataacggtcattatacaagccgactttggctggtgataaatcttgatagatttgaagatgcttgattgtgttattgtctgggtaaaattggcgatcgttgcgaatggccttaggtaatagcgccttggctttccgattaggtgttgcgtaaccgatatattccgcattttgggcggcgttcttgggttcactcataaagttcaagaaggcgtaaatcgccttaaagtgtttggccgttttaggaatgaccaagttatcaaaccacaagttactcccttcggatgggacaacgtaatgcaagtgtgaattgccagccaacatttcactagcctcaccggaccaatcgaccgcgattgcggcttcgttttggatcatgtacattttaatttcatccgctacgacggccttgacgtttggtgatagccggttaagcttgtttcgcgcagccaatagagtggctggatcggtcgtattcatggactgattcattgatgcgagggcgaaccccattacgtcgcgggcgctatcaatcagcataattttgttatggtattttcgttgccacaaatcattccagtgttgaatactgcccggctgaacgtacttgtcgttataaatgataccaagcgttccccagaaatatgggactgagtaacgattgtgttgatcaaaggccaagttcatgaagcgcggatcgtaattcttcattccagtcagttcacttttattgagcggtaagagtaagtgcgcttttttcattttttcaatcatgtaatcactaggtacggtcagatcgtaactggtgccgccttgcttgattttcgtatacatagcttcgttgctatcgaaagtttcgacgttaacgtgatagccagtctgtttttgaaacttagtgagcagactagggtcaatgtagtcaccccaagtatataggttcaaaacctttttgccagtactaccagagctcgtctgcaagcgttgcgcgccaaaggccagtaagccacagacgactagtaagctaacgataatgcttaataattttttcacttccgccgccccctaactgctggccgccggtgccgactactgtattggttaatgaagtagtagccaattactaacaccagtgccatcaggaacattagaccggacagggcgttgatttccaggttgatgccttgacgggcccgtgagtagatttcaaccgacagcgtgctaaagccgtttccagtcacgaagaaagtgacggcgaagtcatcgagtgagtaggtcagggccatgaagaagccagaaaagatcccgggcatgatgtagggcacgatgatttggctgagtaattgccaattgttggcacctaagtcagccgcggcatccagtaaactggtgctcatttcttgaatttttggtagcaccatcaagaccacgattggaattgaaaaagcaatatggcttaacaagactgagccaaaaccgagcggaattttaagggcagtaaagaaaatcaagaaactggccccgatgatgacgtcgggtgaaaccatcaagatattgttcaacgataacaaagtgttgcgggtaatcggtttggtcgtactattgattccgagtgcccccagcgtgccaatgacagttgctaataatgatgataagagcgcaatcaaaatggtgtcgagaaaaatggcaattaaacggctatccgcgaataagtcttggtaatgttgccaggtaaaaccatgaaagttgttcatagtcgtaccttggctgaaggagtaaacgactagaaaaataattggcgcatacagcacgatgaaaacaagccacaggtataagttgcgccacttgaagttacgtaaggtcattatttcgtcaacccctttcgtgcgcgctttttactgctgccagttagccacatgatgatgaccatcgcaataatcaggacgaccccgatcgtcgaacccatgccccagttcattgtcgtcaagaagtgttcctcaatcgcagtcccgagtgtaatcaccttattgccgccaattaaacgggtcaacatgaagagtgacagtgagggaatgaagacggcttgaatgccagccttcacaccggggagtgtcagtgggaaaattacccgattgaaggtctgccaatttgtggcaccgagatcccgactagcattgacgtaagatgggttcagttcgctaatcgagttgtaaatgggcaggaccatgaacggaatctgaatataggccgcgacaaagatgaagctgaaattagtaaagagcaattgcttgggcccgattccgatgaaacttaaaaactggttggcgatgccggcttgactaaaaatgccgatgaaagcgtacgccttaagtaataagttgatccatgttggcataatgattaagagcagccacagctgcggatgcttcgtttcgttgagtaaataagccgtcggataactgatcaataatgttgcgagtgtgatcaagaaggcgtaccagacagagttgaccgtcatcattaagtaggtatttgatgaaaaatacgtttggtagttgcccagtgtaaattgcccgttaatgttgaagaatgattgatagatcaacaataggactggggcaatgacgaagaggatgatccacaacatgtacgggataaagtaggcggtgttacgacttaatcgttgttttggttgcatgttgacacctcctaatcatcttcgtattgttcaagacgagcgtcaaaagcagcttcgctctcgtttaaccgcatgacgtgaatgtcttgtgggtcaaaggtcaggccgatcggttcgccttctgcggcagggttagttgaatgaacgagccattcgttatgatcggtatcgtaagcgacgatttcgaaataattgcctcgaaatagttgggagtcgacagtgacgactaatttgccttgattcgcggccacaatgtcgagatcttcaggccgaagaacgacttcgacagcttcattaggctgcattcccgcatcggcgcattcgaattgtttgccgacaaattctacttcaaaatctttgagcattttacccggaataatgttactttcaccgatgaagttcgccacgaaatggttgatcggttcatcgtaaatatcaactggggacccaccttgtaaaatctcgccagcgttcatgacaaagatttcatcactcatggccaaggcttcttcctgatcgtgggtgacaaagagaaaagtgatgcccaggcgttgttgaaggtcccgcaactcatattgcatatccttacgcagtttggcatcgagagccgataacggttcgtcgagtaagaggaccttaggctgcataacgagtgcccgggcaatggcaactcgttgttgttgtccaccagagatctcactgatttcacgttccccaagatcagctagttggaccattgcgagtgctttttggacccgcgtctcgatttcatccttgggaactttgtgtaatttcaagccaaatgccacgttttccgcgacattcatgtgtggaaaaagggcgtaatcttgaaagactgtgttgacttgccgctgattggccggcagagtgttgatgacctgaccgtcaaagtaaacttgaccggaagtggcatccgtaaaccccgcaatggtacgcagaatggttgttttaccacacccagacggaccgagtaacgtatagaatttgcccgcttcaagatctaagttgatgttttttaaaacttgatgttccccgtaacttttagtgacatttgtcaatcgaatgattggttgtgtattaaccgccaaagtaaagacctccttaaaacgtgtaccaagctagtgtaacctaataccagctcgattagttgtgacatgattataagtaggacgcggtcgtaaccaaggtgaatgtgcaggacgtggtgccaagattacgaatctgatgcgtcttagtcgcatggaagtacagcgtatctcccgccgtggcagtatattgctgagctccgagctgtaagcttaaagtgccggtttgaaccataataaaggtctctgccggcgacggctcaaaagatttgaagcgaccactaggtgccagtgtgacggtgaccggttctaactgattttcgttagacgcgggtacgagccatttcacacggtatcctaaggcttcatcgtcatacgtggtctgatctgctggatggtagaccactttgtgagtgggctgctcagccgcaaaaaaatcagcgggggcacaaccgagtacttcaagaatcgcgaagaacgtctccattgaaggcgatgactgattgtgctctaactgtgatatgtaccccttgctaaggtcagttcgttcgcctaattcttcttgcgtgagttgcttttgaatccgtaagttgcggatgcgttgaccaatgtccatgacattcacctcgaatcggtagttttgttaaactaaacaataagtttagtacgagctttaattataatgaaaaatgacgtggtgacaagcattttttacaattggcagcttctttttttaagtctgccagcttgtctggtcaaatcgcccagaaacagtggtgttgaggggttggaactgtcgtttggttagtgaataaattaggtgcgttgtggacggactttttgtggcgtgccgctgaagcctgcgcttgctacgccaacgaatcaatgtaaaaatcgccactgcaatatagacgaaacgtgttcggagcaacctgggtcttgcggttagcccagcattgctgccggctaggaagcccgcctagccaacatcaatgctaagctaatcctcagtcccaacccggttgtcctcgcactctgctgaaacatgttcggagccgctgaagcctgcgctggctaggcaatgctcagcttcaacccgcggcccctcacactctaataaaaaagcccaagacatccgtcttaggccgttagcgttgttgattaatccgcgcggtaaacgacttcaaaaacttcactgaccatcggtgtgtccgatgagaggtttttgccgtgttcttctaacgtcggggtgaattctgccgtcttacgcttgcgccaatcaccaattgtgcgatcaccatcgccttcatggtaagcgtgttctgccgagatgcgataaaacggaatgagttcagacaccaccgttttcagaatcgcgaccggtttcatgtcaccatttagcaagacgttgtagtcgccaacttgtggaatggcaatttgttccgcggtataactgtccagcggcgtggttgtcgctgtcttcgtcccggccagaattgcgtcggctaaagcagtcacttcggcagggttattttgttgaccgaaccaacgtgtttgataagaagccccgtttgtgtcggtgctttcgttataagcatgccataattgttctgctgattgagcgggcataaaggtcacctaatttcgattagaattattgaattcgaatgcatgtaaccgaattcacaattcaagtatagcatgacatttctgaaaacgacacgttcgacactggtttttcggggaaaattaagttagtcaactattgaccgacatttgctataatatacgtacgaattggagggcgaaaatcaatggaaattacacctgttaaaatgctggatttaccacaaatcatggcgatcgaaaaatctggtttttcagaagcagaggctggcagcgaggctgcttatcgcgaacgcattgagaaattagcggatacttttctggtcgcccgcgatggtgcagtcgtacttggctttatcgtgggaccagctgtcggtgcccgctatattgaagatgagatgtttgtagagacaccgactaacttgccacgtggcggccatcagctggttttcacgttggcagtttcgccactagcacgtcaccaacagatcggtagtcaattattgaccgcgctagctgagaaggctcaagcagacgggcggacaagcatggcgttgacttgtttggaacgactaattccgttttatgaacgtaatggttttattaatcaaggtgtggcgaactccgaacatgctggtgaaacttggtataatttagagaaagtctgggattaaatcatgaaattagcaacattacaagcacaattaccggattttgagatccgattactaactttagctgaccaggaagcattgctaaagctggaacaaagtaatccgcgctatcaccaatatttctcaccggaaccactaacgatgactgaggtacaacatgatttgacggcccacccggacgagctagcggcggcacaaaaacaggtttttggtttttacttagcacaccgtttagtagccgttttagatgtactcaatcagtatccacaagaacaatttttattcgttggattactcatggtcaataaggcttaccaacgtaaatcagtgggccgagttattgtaaccggactgatgcaagcggcacttcaagcgaatataacggcgatccaactaacgcgcgttactgctgatgaaggggtcgcaagattctggcagaaactcgggtttgaagatggtaaccagttgttcttacctttaaaagccggtggccggttagcggtgacgacgatgacacggctactccaatagaattctcatggaactcttagcaataaggcctagtaagcgatatcagacatgttaaactcgtgatgactaataaatagaaatgaggttaacacgatgattaagcattggggaaaagccgaaactggcatgttgattgcagccgtattgttattaatggtaatttttaccttttttgaaattacggctagtttaacagttagtgtcattgcttttccgattagtttgattgtgttgatggcgattatggaattcgccgcaacggaattacggcgcaagtaagtgactcgcagatagatcgtaacctaatatcgtgcttgtttagcaggagcacgtatatatagaagcccgtatttaccacgattggcagatacgggcttttttcgtgacggctgaggactattcctactaggtctaaaggacactgtttggactgtacaagtggcctgattttaacgttttcttagcttgtttataactgtactatactgtactatttaacgtaagcgaagtaacgactgtgtattaaatggaggtgggccatgcaaattgatcatggaagccgacaaccgtattacgctcagatagtaaccggtattgaacaagatattgctcatggtgtgttacaaagtggtgaacaactgccgtcggtgcgtgaaatggctcgtcaacacttgctgaatccgaatacggtcagtaaagcctataagcgactggagacacagcaaattatcgagacggttccgggaaaaggcacgtacgttaaagtggtggattcaacgctgttccgacaagaattacgggaacagtttacacaaattgtcaggctagcgggtcaaagaggcgtcagtattgctgaattgcatggctggcttgatcaaatgggggaaaaataatgagtttagtgattaatcagttaagtaagcgcattgaccatcaccagacgttagatggcattagttttgagattggacttggtcaaatcgtcggtgttgttggccgtaacggggttgggaaaacaaccctttttcggacaatcaatgggcagtacctcacggatcatggtcaggtcctggttgatgggcaagaggttgttgatcaaccggaaatgcggacgcaactgtgttttattgatccactggcaaatttttttaaaggcgcgacgattgcgcaaatccagtggtattatcaagctgcttacccggactttgataatgccaaatttgcgcaattgttagaccgttatcatctgacgtccaaacaaaaattacgccatttctctaagggaatgtttggtttgtttacaatcattctcagtgttgcgacgcaagcgccgtatctctttttggatgagccgctagatggtttggatgtcctaattcgaaaaaacattcttggtattctaattgatgaagtggctacgggaaaccgttcaatcgtgattgcgtcacataatttggctgaattagagggggttattgaccgcgcgttgatgcttaaacacggtcgcattgtcaatgactatcaattagaagccatgcgacgaagtgcacgaaaagttcaattagtgtatcgtgacaagcagatcccagccgttgttaaacaattaggccatattgtacacgtttctggtcgggttatcgtggtagtgtttgaagattataatgctgaggtccaggcgcaattagcgacaactaacccggtatttcaagaagatttaccactctcattagcagacttgtttatggctaatctgacggatgaagctgactttgaattattatcttagggggacgataaaatgacgaaacgaaagttatggcagttgttatggcgccactatcgcacgttgttattaacggcgggcggtgtcttactactagtaggcataaaggaaggctacagtattgcccataatccgtcacggtatgttgcacaaaatgtcagtagttttgcgttgatggaagccactcatcttcggatggaaacggtggtcgccatcatcgttagaacgtgtttggatacnnnnnnnnnngattctaaacacgttcttagtctggtgctaggagtcgcactattcttaagcgataatttcacgaattttaatcaatatttatttagtttgccggtcgctcgaaagcaaatttatcggcgtaagatcgggttacttattgggatgttggtcagcgcatacatgttggcggaagctgtttttggactgattgcttggcgcgtgttggctaaacagcaggtgcggattgattggcttacgacattgtatgaagaacttggaatcctggcagtaatgttagtgtttggattattagccgctacgttcgggttatgggttggccatatctttgcgagtgcgcttgcgacatttgtcttcgtttgtagcttgccctttgcatatgatggcttgatcaatcttgctgcaggattaacgaagcttaaatatgagcaggtggatgttttaggtcagctgccgagctggaaacccgggggcttactaaccacttgggtgatttgtggtgttatcggtggcggcctgtatttgcttaaccgctgggcgtttgagcatttatctttggaaaatagtggggattttttccgctttccgcagtggcgcggagccgtcctgggcttttcaattatttatctaattgttgcaatttgctgttcacaatttggtaacggtgttttagggttgctaacggataactatcatgcgcatatgccattatcgactgggattataatggcgctggtcgttgcctatctaacttggagtttggggcggtggtttctgtaccgaccggatcgttttcgcgatgcgtggacggttaagaagttggcttaacttggtcataaggtagattgtaaaattannnnnnnnnnaaatttgcaatctaccataaatctaaaatgcgcccgttgaagttaagcagactgacttcagcgggcgcatttgttagcggcaattttaaatttattatcctgattgatgaaactttagcgaatcttagttaagcgttttgcaacggtcttaatatttagtagatcccaatcttccaagttgtgtgaaatcgagttatgcccccatgttccacaaccgagtgttaaggatggtgcgacgttatcatatttataaccaatggcaccttgtgaagacggcacgttgatcaatgctcgacaagcagtcatttctaaggcaaacttgttcataacagcttcgtcggtcgtatgcaaggcggccgtatgtcccagtccgccaagtgctaggctgcgtttcatcaggttgaagccggcctcagtatccttggcatgaacgacggcgaggactggtgataacttttctcgtgataagacttggtcaccaccgatgctaggcaattcaactgctaatactttggtatcggatgggacatcaaagccagcccactgagcgatttgccatggcgtttgcccagctactttcgggtcaacagcctgtttatccaggttcatgacagttgcttctaaggccttgaagttctcggtaccgacaaagtacacaccgttgtgacttaattcacgtttaacttgatcatagatttgatcagcaacgattaagtttgattcggaagcacagatcatgccgttgtcgaatgacttggaagtgacgacatcactgactgcctgttgaatgtctgcggtttgctcgatgaagcatggcacgttaccagggccaacaccgagtgccggtttaccagttgaatacgcggtcttgaccatgccggcaccgccagttgcaataatggtagcgacgcccggatggttcatcaaggtgttggttgcttcaaggctaggcgtcttgatccactgaatccaatccttaggagcgccagcggcaatagcagcatcgcggatgattcggccagtttcaacacaagatttttgtgcaaagggatggaaaccaaaaataatgggattgcgagtctttaatgctaacatggcattgaaaatgacggttgatgttgggttggtaactggggtgacccccgcaataattccaactggttcagcaactttcatcacgccactgactggatcgtcattaatgataccgaccgtcttgtcatccttgatgtagttataaacgtttttggctgcaaagtcgttcttcgcaactttatcacgataatttccgcgacccgtttcttcgacggccatagcggccagcatgccacgagcagcgtgggcagcgcgggccatggcagcgacagcctgatcaacttgactttgatccatgacttcaagacggttggcagctaacgaagcatttaagactaaccgatcgattgaacgtgatacggttgtttcttccatttctttcagcattcacggttcctcctatgcaaaatcaacttgtttcttatttcacaatcactattataaatactttttcacaaatgtaaatagctaatatttaatttcataaattgcttttaaaacactataattattgatttaatagcgtatataaatgtaaataaactgttcgcttacattttcaccgaacggatttctgttataatattcacaattaattattgattaaattcgaagcaacttttggcttgatctgtaactgattttatataaatggaagggtttacaaacgggcggttgtcaaataagcaagaattgacggggaatcgttggttaataaatatgacaaatcggttatcactcctatgtaaaatgtgctaaaatgaatgtgattcaaaaatcgtatctcttaattaacctaggagggttattttatgtcatttgtaaatgctgttgatatgacacaagacgcatacaagaaccattatgctattggtgcgttcaacacaaacaaccttgaatggactcgttgcatcttgaagggtgctcaagacactaacaccccagttattatccaagtttcaatgggtgctgctaagtacatgggcggctacaagctcgttatggacttagttgctgatgaaatggaaagcatgaacatcactgttcctgttgttatgcacttagaccacggtaactacgaagctgccaaggaatgtatcgaagttggttactcatcagttatgtttgatggccatgacctaccatttgccgaaaacttagaaaagactaaggaaatcgtcaaattagctcatgctaagggcatctctgttgaagccgaagttggttcaattggtggtgaagaagacggtatcatcggtgaaggtgaattagctgatgttgaagaagctaagactttagctgctactggtatcgacatcttagccgctgggattggtaacatccacggcaagtacccagaaaactggactggcttacacttcgatcgtcttcaagaaatctcagaagccgttaagatgccattggtacttcacggtggttctggtattcctaaggaccaaatcgttaaggctgttgaattgggtattagcaaggttaacgttaacaccgaaaaccaagttgcttttgccaatgcaactcgtgcttacatcgaatctggcgcagaccaaatcggtaagggctacgaccctcgtaagttattggcacctggtaagaaggccatcgttgatgttgttacatcacggattggctggttcaagactccagctgttaaataattggatttttgattcagaaaaagtcgactcctcggggtcggcttttttcctgcgcttttttggggaacttgggactgacttatcacctgggagtgccagtgttagtgtgcccttttctggttgctattatcggggaaccgattatagcgtgatttttaattttgcggtttgctaaaataacggtaacttaatgggatgctgttggtatccaattgaatgaaggaaaaaatgaggtcagtgattctcgcatgccgagggtcactgacctcattttggtgttaagaacggataactaaacattaatcgcgtcttgcaattgctgctcattgtaaaaaattaatacgataaacatcaccacgtaaagtaataatggtaaccacgcatagttcagggtaatcatatgctgagtggcgatattttgcgcatgattggccgtgtagccgcttaaatgaaagagtccggcggtgactaggccaccaagtcctaagccgacattaacgccgaagtcatcagtagaggctaaaataccttctgcttgaattcccagcgccgtgccataacggatcgtatcagcaatcatgattgagaccaaaccaatgatgagaccgttaccgacagcattgatcaacgtaccaccgaagacgaaggccagttgattgatggctgtcccgagaccgaggatcagttgccccacagcggcgattgcgatacccgccaacatggtattctttttcccgtggtggttggctagccggacaattaagatgaccccgatcagtgacgcaaacgtaaagccgttaacgactggcactaagtcctcacgctgaatcaagtatttaaagtagtagatggtcgtttgattcttgatggcggttgttaaccaatacagtaaaatcacgctggataaaataaaccacggctggttttgcttgagcatgccccacaccgcactgagtgattggtgcggacgctcaggttgactaaagcgttccttgacttggaagaaggtgttgaggatcagtaccaacgaaataatgccaaatagaacgattgtcagtaaaaaccctcgttgctgatcaccctgaccaaataaagcaactagtggcaaggtgaagacagcgacgataatttgaacgctactaccgaagaattgacgaatcacgcctagtaaggttaattcacgttcattctgggagagtgctggtaaaatcgatgtgattggtaggttgacggcggtatagaagaatcctaaccctaaataggtcacataagcccagacgagtttaccagttgctccgaaattcggggtcacaaaggtcaaaacggcgaacaagacgtagggtaacgcgtaccataagaaaaacgggcggcttttaccgaagcgcgaatgggtattgtcaatcatgacgccgataatcagactttcaacgacatcggctaagcgcgcaacgacaaataaaatcgccgctgcactcgtggataggccgtaaacatcggtatagaagaataataagtatgtggtcatcatctgaaagactaagttatccgcggcatcactgagcccataactaattcgttccggccaagctgtttgccaaggttgtttcaatattaacacctctaagtatggttttgcacaatctaattctaacctagttgcacgcttaaacctaacggaaaggtttacaaaattgattaggtcttagattgatcagaaaaaagcctgcaggtggcgttcgtcaacctgcaggctgtgcattgtttgtcctgattaaaagctacttagttgttaatttgctgaccttggtgagtgctgggattaagcccaagctatctaacgtttggtttggtaaaacaacggtgttggcattgccgtccgctaaggctttgacagcttccgtgttttggaagataaagtagttttcggatgattgtgccaaggctttgtttaagatccgcgtccggtaagcatcagcatctgcttcagtttgaacggctgttgctttcgcctttgcactattcactaaagcttcgttttgggctttgttggtggctaataaggcccggttattggcttcattttccagtgtgattgacttactcttaccttcagcagttgcgatggtggcatcccgttcccgcgtagcttgcaggagtttattcatggaagcctgaatatctgccgaagggttaacggaatcaatattgacccggtcaacatttaaaccgtagcccgccgtaacggaggagatctccttgaagagggcggcattgatttcttgcgtcccattcaggacttcatttaattctttgttcccaatgataccacgcagtgccgcgcgggtatcttgaatcatactacgaacggagtcttcgtttttaaaaacgaagtcttcaatattagtgacgtggtacttaagcgaaatcttaactgagatttcagcgttatctttggtgataacgacttgttggttaagatcaacgggtgtctgagccgtgttaacggtgatgacacgtgagatgaacggtttaataaagtgaaagccggaactaatgacgcgctcgaactttccaaatgttaagacgacaccttggttcggttgggtgatgatgcggatggaagcgattaggactaaaacgaccagtagaatgacaataattgcaacgatgatgcctaccataataatttccccctattgttgtggtgcgataatcgttaccgttagaccatgagcactgacggccgtgatttcaacggtatcgccgatgtgcagtggtgttgcggcgtgcaaatggtacaagatgccatagaatgcgacgccgtcagttagatcggtcggtttgataatgaagcgctgaccgattaagcgctgatctaagtatccctcttgcatagatgacccacctttaatgtgataataattaaattatatgctgtttttggttagattgatagggccgttataaaatagtgggtgagttttggattgttgataaagtatggcgataaatggtgaattcatgctgcatatcgctcagtaactatttggataagctcgttttagagggcggttcagtaatacggagttaaaggggcgcttgaagtatttaagccgacaaaaaaaccttcgtacgggaatacgaaggtcaaaaggagtaggtcagcatatgacggggaatcatatgctgataacttgatgagcgtttattcatataagcggggggacgttcacatgccgctcatcaagctgtcaaagttgttacgctttgacggatttcattactttggaggagtaaatgaaaagaatgttaattattatagtagcaatcttggagggggatccttaattgctatagatacatattaacaacgaattgtgaagaaaatgtgacgatgatttttcaaatttaagaattattgattagattacgaaaagatttatgactattgataaatttatcggcaattaaaattgcgtaagaattatctgtcagcgctttcgcaatggtggctttttaaattagagcgtgtatcattaataatgatcacggaaattaaagacaggagatgcttgcatgtacgaacaagcttgtaccacaattttagttggaaaaaaggcgaccgttgatggttcgacgatgattgcccgtaatgatgatacgtttatgccgattacaccgcaaaaatttatcgtccatcccgctgttcatggtcgcaacgaaacgttaacttctgggaagaatggctttaccgcaccacttccaacagatggttaccgttaccaagctgtaccaaacattgaagtcgctgaaaagggtgtttttgaagaaaatggctttaacgaaaaaaatgttggtgtttcttcaactgaaagtgtttatggtaatgaacatacgctgacttttgacccattcgtgcctaatggtctcgcagaagattcattaccaaccatgctcacgccgttcattgattctgctcgtggtggggttgaatacttgggccagctgatcgctaaatatggttcgccagaaggtaacggtgttttgttcaatgataaagatgatgtgtggtacatggagatcgtcactggtcaccactgggttgcacaacggattccggatgatgcttacgcggtggctgccaaccaagttgcgattcaatgggttgactttgatgatcccgataactttatgtggtctgatggcattcaagaatttgttgcggaacaccatttgaatcctgacaaagaaggctttaacttccgtcatatcttcggtactgataatgaaaaagaccggcattataatactccccgggtctggtacggccaacgttatttcaatccagagatcgaacaagatccacagtcgagtgagctaccgttcatttgtcacgcagccaagaagatttcagttgccgacgttgaatttgtactgggttctcattataacgaaacgaagtacgatcccttcttgaatacaccagaagctaaaaagtttcggccaatttcaatgaatcggacgcagaattcacacgttatgcaagtgcggaatgacgtaccagcagaacaaagcgcgattatgtggatgacgtttggggtaccagcttttgcgccataccttccattccatgcgaacgtttctgaaactgatcctagttttgcgaacacaccgctaaaacatgatatgaatagtgcttactggctctaccggacactatcaatgattgttgaatcacactatgctgatttcgttcaggatgatattgattatttgaaagaatgtcgaatcgaactgggtcaatttgtggctgcgaccgatgaacaagcggcgaagttatctggtgacgagttaacggctttcttgactgaacaagataaagtgatggtcgcaaagatgcgtgataaagcccaagctttgattggtcaattagtcaccaaaggtttaacgctctcgaaactaacctataatgttgatatcaatctttaaactttcgttatgacggtatcagcgtgtataattaagttattaagaggacaaggagctgatggcaaatggatgaaaatgtcttatttaatcctggtgacgcaatttcagaatcgcatgactacaatgaagcgctccgtagtgcggatatttataatgcgcgtcacggacgtaagcgcggactcatgattgcgcggccgctagaacaggatcacggttattcggttttttacgcggatgatttactgacagccgatacgccaagaccagaagcacgtcaatatcacgttgaaaagcgtattccaaaagaatagtgcagtcatcccatgatcagtaaaaaggatcatgggattttttattcgctaaacagtaacccagctagttgatattgggttactgttgttttataatagcgtttaaattgattaacaggggtgcgatgatgacgaatcgacagacgattaaacacctgacccagacggcgatggtgaccgctttgattattgtattaggtttctttccgggaattccagtgggctttattcccgttccgattgtgttgcagaatatgggcatctttttagccgccgagttacttggccgcaaatatgggacgatcgcagttggattgttcttaggattagtggcactgggactacccctattatctggggggcgtgggggtgccgcgatttttctcgggccaacgggtggctatctcgttgcttggttgctggcaccaatgctgattggaacgttgatcaaaataacccgggcgatgacaagtggttattggtggctagaagttggcattgtctggttggctggtatcttatttgttgatgtaatcggtgctagttggctagctgttcagtcacatatgactttgacggccgccttgctgtcgaacgtggcctttcttcctggtgacatcattaaagggactttggccgtatttattgcccggcgtgtgcgggccatcgttgattttgaattgccagcttagtaaatagctaatgtgattggcaggtcaggaggtcataatgacaactaaagaacaggtcttaacaattttattgcgtcatcatggtgagtggcaatcgggggaccagcttgcccaatcagttggctgtagtcgtgagagcatttggaaggcgatcaatgccttgagaaagcaaggacaccagattgagagtcgtaaaaaccggggctactgctatctggaaagtcgtaatttggatgccaaagccattcaaatctatgggcaacgtcaatttacggggccacttgaagtggtcgcccagacgccgtccactcagattctagctaagacctttttaagtcatcatcagccacagtttgctgccttcttcgcggatgaacagacagctggctatggccgtttgggccgggacttctattcaccggccaaaactggactgtattttagcttggttgttcctaatcccacgaatgcattggtcaatgtgggcttactgacaactggtgtcgcagtgagtgtcctgaatgttttgcagcaattttatcctaataagaactttgggttgaaatgggtcaatgatatttatcttaatcagcataaggtcgggggcattatcacggaagcaagtttggaattagaatcgacttccgcaacggcctttattgtcggtgtgggtctcaatttaacgaccaccgattttccgcgggaattgcaagctcgtgcccaggcggtcgacccgagcataccagtggatcgcaatcggttagcagcggccttattatcagtactagtagcgctatcaaaacgctacgctacggccgactttttgccagcatatcgggctaaatcactagtgttgggtcaacaagtgacacttcaagtgggcgattccgtggtgaatggggtggctgaagatatcgatgaacatggtggcttagtggtccgcatgttgaccggggagcggcggacatttacgagtggtgaagtgatcagggtagggttaccagtatgactgagtgggtaccagtgatttacggcatcggtttagacgctgccggtcggtgccaacattatcaccttgaaactgatattgcggcattgtggtgtcggcgatgtcaacactattacgcgtgttaccggtgccatgatacgttgtgccagcatacttttgtggccagcgctccgacggatttagccgtgatgtgtggtgcttgtcgttatcgaatgacggttgatcggtatcatgaggggcaatgcccgcactgtcaccggccatttaacccgcggtgtcggttgcatgacaaggtttactttgaaaagcaaaattgagacgtattttagtagttttggctgaattcagtggttaatcgaaaaacaattaaaaaattgacatattctaattaaaaactcataattaagcttggaattatggttgattgtgaatttgtgctgacaaccattgacagaagggaagcactaattttgaaatttgaagagtccaaaattttgcagcaattaccaaaacagttctttgcgaatctggtcaaaaaggtcaatgccaaagtggcggccggtgcggatgtgattaatttaggtcaaggcaatcctgaccaacccacccctgagtttgttgttaaagcaatgcagactgcaactgccaatcccgcggatcacaagtattcgttgtttcgaggtttgccgcgattcaaacaagccgcggctgatttttacgaacgcgagtacggtgtgaaattagacccggagactgagattgcggttttgggtggcagtaagattgggttggtcgagttaccctttgccttactaaatccgggcgatacaatgattttacctgaccccggttacccagactatttatctggtattacgttggcacaggtgaagttggctttactacgattaacagcggacaatcatttcttaccggattatcagcaggttgatccacaagtggctgcggcggccaagctgttgtacctgaattacccgaataatcccactggtgctgttgcaacgtcgcagttttttcaagacacggtggattttgcaaatgaacatcagattggtatcgttcatgactttgcttatggtgcaattgggttcgatggtcagcgaccagtgagcttcctacaggcatcgggggccaaagacgttggaattgagatgtacacgttatctaagtcctttaacatggcaggttggcgcgttggttttgctgctggtaatgctgacatgattgaagccttaaatttgattcaggatcatctgtttgttagcgtctttccggccattcaagatgcagcgattgcagccttgaacagtgaccaacagacggtccacgaactggttgggctgtatgaacgacgccgtaatcagttctttacggcggcccgcaagattgggtgggagccctacccatcagggggctcattttacgcttggatgccagtccctaaagggtataccagtgaagcatttgccgatttgctgttggataaagcggcggttgcggtggcgccaggaaacggctttggtgcgggtggcgaaggctatgtgcgcgttggactcttgattgatgaaccccgcttcacggaagcctgtcagcgaattgcaaaactgcacttattcgatcgttaggatgacctcttagcattaatgatgacagccaatcacttactgagcataattcatgcaacgggggcgcaactcgtttttgattgctcggaaatattgagctgtaataacggtatcaaaataacgcaactggcatgtgaatgccagttgcgttattttgattcgaggtattgaattattataaattaccggtgctctttaaccgcttctctaacaggtacgcgtccatgtacccaaaggataattcaacgacctgatcgagttcgatcatcgtgccaacatgattaatttgattatcatcatccacgttatagaagatgaagtgcccgttcgttaacgttcccggatagccagtcattgctggcaacatggggttttctgtcgtgatgtgaacgaggttattgaaagttgcggcttgtcgcaaaattgaatcaaaaagatcagttgtggcgtcaaataaccgttcgtcgtttaagacgggttgaacatttaactcatactggcgatttaattcaataaagccacgcatcgtttgtaaatagtcggactgggttgtcaccgattcaattagtgaacggcgacaaagggtgtagcccccaaattggcccgtcatatcgatcagattgagcaggacactatcagcgttcaatgcgttaatgaagccaacaaagaacatgtcagacccgtccgctgaccgaattgcaatcagttggtgctcatttaaagcgttgtttagagtatgatcaacgtcgtcaaactcgctgactttgacggttgctcgatgcgtatggatggtcttgacaaaggcgctttccaataagagctcattgccgcaaaactctaatatctgaatagcagccaatggaatttcctgttgcccgttgtttttaaagttaaatttgtcaaaagttttaaaggtaatcgtttggtcagtgacttgttggacctgaccttctaaataattttcgttgtcttcgaggactagtagcacaacttgatgatcggtttgggcttgggtgactaactgtgttaggactggccgttgatcgtctaaagctacggttggttgtggcacactgttcaaaccttcagtagttgcattttcaaggcgaaaggccatgttatcaaggtcttcactcatcatttcaacttcatcaatgacgtcgtagcgcatgaagacggcgccgtcctggagcccagcatcatcgtaagtattcacgacaacgccatcaggtgccagacggtcgatgtagccggtgtaaaccacttcgctattggcttgatataggttgatgaggtgaacctgttgtgcggctaattgtaaattctcaataattgaactcatcgtgtctaacccccttagttaatgttccctcatcatagcactttttgaggtgaagacgccattataagtcattattcagctggtttggtaagtgtgttatgactaggtaagtaaacggatgctcacgtgctattcaggtcgctcatctcattagaagggccttgttctgcaaatttaaaaccgttttcgcttgcacccggacgctgtcaccggcattgagtgcggctgtttggtatgtgtgcaacacaacacggtgctggtcatcgctacgtaaaaaatagtgtttcgatgatgcgttcacggctagtgatcttaaagtgcaattcgatattcaaatgatgattgccaaaataaacgcatacgggttttttaaaacacaacgtatgtaagggctttctttgcttgtgaaataggagtatcggtcaataagtatccattgataataggtaaatatttaataaaaaatgttattttcggtgctattaacgaggtttatcgttataatgtagtctgcggtttatcttgaccgtaaatctgtcatgacctttcaagaggcgcttgatcgtgttgcgacatacatttaaggagtgcactatgtttacgatgtttaagacgattggcgatcagttcgccaatttcaagattattcggcgaatggcgaagtatgatgatcgggccacataccaaagccattaccttgggttagcgtgggaatttctaaacccactgattcaaatcggaatttattacttagtattcggggtcgcgttaaaacgtggcgatccgatgccaggaatcccgtatttaccatggatggttgtcgggattgcaccatggttatacatgaacaaaacgacgctggacgcgtcttctagcatttatcgtcaggttgggttagtttcaaagatgaaattcccagtcaacgtattaccgtcaattaaaatttatggtaatttatatagtttttggacgatgattgcttttgggatcttcctgatgttcattaatggtatttggccctcagtttcttggattcaatttatctactactttggttgcatgatcgtattaatgtattcacttgggatcttcaatgccacggtcagtgttctgattcgtgactggcatatcacgcttcaatccgtattacggatgctgttctatatgagtggggtgctatttaactttacaacgtccaacttccccgcagtttttgtgcgcctactagaactaaatccgttctactacgtgctcaacggaatgcgagaatcgttgcttaatcgtggttggatctggcaacagcctaatatcacgttgacgattgtcttttggctcttcaatctcgttgtgattctgactggaacgtatctctataacaagttccgttcgaactttgtggatttgatttaggaggcggaactgatggaaaatcaatataaggttgaattgcataatgtcactaaagaatatgatttatatcgtagtaacaacgataagttaaaacacttttttaacattggtaatgttgatgtcccgcggttttggtcgctaaaaggggtcagcttaaacgttaaaccaggtgaagcgttgggtattatcggaatcaacggttctggtaagtcaacgatttcgaatattatttcgggaatcattcctcaaacgactgggacagtggatgtgcacggtgatacgtccattatttcaatcggagccggcttaaagtggaatttaaccggtgatgaaaacattcggttgaaaggactcatgcaagggttgagtattaaagagatccaagcggttcgtgatgatattgttgatttcgcggatattggtgattttattggtcaaccagttaaggactattcgaccgggatgcggtcacgattgggatttgcgattgcggtgcatatcaatcccgacatcatgattattgatgaagcactatcggttggtgatgacaccttctatcaaaaatgtgtggataagattatggaattcaagaagcaagggaagactattatctttgtcagccataatttacggcaagtagaattgctttgtgaccgggtcgcttggatgcactttggggatcttttagaagtcggcgagaccaaggaaactgttgatcattaccggaaattttctaaggatttcaaagcgcaaacggcggcttatcgtaagaagtatcaggtcggtaagaagaaggaacaagcggactttgacattgtcgcttatgaacgacaattagtcgaagaaaaggctaaggatagcgataagagtaagcaggcagttagccgtcaagttcatcggacgctatacaagcaaatcttgccagaaaagatgacgattgccaccaagctcgtcatgttagtggcaattgtcctgttcgtcttctttgcgttagtgaatgtttcaggtcactcggttacttcggcgattgagaatccgacagtactgttacatccagtcaatcattatattaaaagtcagtcagtcttattcaatagtaagtgacggcggctggttagtggttgcattaaattaacattaatatcgatgggtgattgcgatggcaatcacccattttttgtgtgcattcaagacggctttggttggaataaagtacaatacaacgtcgcacattattcggactgggggacgctgatgcttttattcgaggggacgagcttgggctgaccgtactaccgatttgaaaggaaaatgtctaaacttcaatgcacaatttatgagttggtttcgggttaaattaagcttgattttttgtaatgcttcagcaatctagttatattcgttataagcattagattattttccgcctggaataccatttggtgggttatcttaatactagagcataaagggggtcatatcatggatacgccactattcttaaatgttgtcgcctatgtgctattaatattggtattacaatatatcaaattcaaatttccagacagtacctttatccgtttctttcaaaaatacgggtggtggttaattgggctatgttttgtcgcaatattggtgattttggccggaccgcaatttcagaacccctttaatgcgttagatgtaccggctattggggtcatgttagtattcgggtacttctttattaaggataaaaaatcgaaacataagtgatgattaaatgagatagcacctcgaacgatgatgtcgtcctgagaggtgctatttttttgcctaaaaatcgatttgagaagcactgatgtttagccgttttaatctagcattaaacgtgaactgggttattcggtaacggaggggcataattaaaaaatcagtttggaaccttgcaatatatctaaaagatatatatacttaacagcgcgaaggattggtgaatttaatgtatgaattgtttattttaggacagttgatggatcatccgatgacgggctaccagttgcgtaaagcgctggtaaacgtagttggttcagaattaaccattagttttggtgcgttgtacccgttgctagataagttagccgcggctgaagaattaacactggcgtttaagcggaccactaataaacggccacaaaagttagccacgataacagcggctggtcgcacgcaattttggcagttagttatgacgccagtcgcgctcaacaagcaaacgcagttaacgtttcagataaagctgaattttttacatttattaagtcgtgatcagcagcaagtaatcttgttggattttcagcaatttgcacggggacaggtcgcacgcttaacggcgcagcacaaacgggtgatgacgaatacccacatgcttgcagctgatattcaagatgcgttgatggtcaatgagttacaacgggtacgagcccaagcacaattagactggcttgaccgccagttgcgcaatggaggggaagttaagggatgaaaacaatgtcgtttgcgactgatccacaaattcaaaagcatcgctggtggatactggttgcggtatgtttatttacgttcatgtcaacgttagatgggagtattgtgaacattgccttgccagtcatgagtaaggatttagcgattccaatgaatcaggcggaatgggtcgtctcaatttatttgattgtgatttgtgcgttattgttattatttggtaaattaggtgatatttacggtaagattcgggtgtttaaaatcgggtccttactattcattattggctcgttattgtcaggattcagtgtggggttgccatttctactcattgcacgcagtattcaagcagtcggagcggcaatgacgatgagtacgaacaacgggattattaccgaagttttcccgtttaaggaacggggccgggcgctaggtatgattggctcattcgttgcattggggagtattgctggccccggtatcggtggtttgatcctagctcatttgagctggggctatattttctggatcaacgttccggtaggaatcttggcgatgattttaggtgcaatgattttgccaaaagacgttacgacgacgcaacaaccattggataagaccggggcggggttatttgccgtactcatggttgcactatttgcaggtgtgtttatcgggcaacagattgggttcttgcagccggttatcttagccttgtttgcagtggcaattgtgacgctgattatttttgttcacgtcgagttacgtcatgaaaatccgctgctagcgctacaattatttaagaatgcccgttttagcattagtatcttatgtgcgttattaatttttattgcgaactttttctttaacgtgattgccccgttttatttggaaaatgctcgggggctagcggcaaactatgcgggctacgccttgatggtattcccaatcgtacaagtggtggtcgccccgattgctgggacgatttctgacaagatcggaccagaattgttaacgttcgtgggattggtcctgatttcaatcagtcaagtgggttacatggttgtggggctagcaacaccactttggttcttcttattattcgtcggattagttggatttggcaatggtatcttcatggcacccaataattcgatcgtgatgagttcagtggcggtcaaagacttgggcgttgctggcgggattaacgcgttggcacgtgaattaggcatgattgttggaatttcggttgccacgaccgtactatattcggcaatgagtcaatcagcggggtataaggttacgtcatacctgccagctcacccggagatctttattgatggtatgcacattgcgttcgtggtctcgttagggatttgtttagttgcgacggtcattactggcgggcggttactaaaacatcgacgcacggcacctgccaagtaaacattagcaaatcaaaaaacgtgttgcgagaaatctgagatgatttcttgcgacacgtttttatattcttgcatccttgatgttgctgaaagggggtctggttaaatcaggcttgttttaaagatccagggcataagctcactgaaaaaaactcggattagcgccgttatgacgccaaactcgtcgtttaattccctagttaggctaatcctcagtcttctcccgtctgatttatgcccgcttgtgatactgagcattgatagaaatgtgccatgcgactgctttctcgaacgcactgaaacctgtgcatattacgcccatgattccgattatcggaatcgttgttgcttatctagcagttgcgctaactgaccacgaaattcatcgctatggtgttgaatgttcgtcaagtcgtgactcatttgaacggtgtagtcagcgacttcgccgtgttcgccttgatcgagtccgagttcttcctcttgttcgtcaacgcgcattctgatgactcgtttcaatagtacgataatgacgatgcaaacgatggtagtaaagccaatggtaaagatcgttgctaatagctgtaatccgaataatttaaagccgccaccatagaaaagaccgtttagagaaattgtgttattaacggctttgctagcgaatagcccagtcatgatactgccgaccatgccggaaacaccgtggcatccaaaggcatcgagtgcatcatcgatacctaagcgtggtttgatgaacgtaatgaagccgtaactagttaatgtggcgataaggccaatccaaaaggcaccagaaatggtgacgtagccacaagcaggtgtaatcgcaacgagaccacaaagggtaccggtgcagacaccaactagggttggtttgcccttggttagcatatcaacgaccatccacgtcatcatggaagtggcggtggcaacggtcgtggttaagaaggcttggatggcgatgtcgttcatggcaagcgccgaaccggcattgaaaccgtaccagccgatccataaaatagcggtccccagcaatacccataagatgttatagtgctgggtcatatccttgccatacttgtggcgggcacctaagaatgctgataagactaaagcggtgataccggcattgatgtggacgacggtaccaccagcgaaatcgatgacgccaagtttagctaataaaccgttatcccaaaccatatgaaccattggatagtagatgaggagtgaccagaagatgatgaaggttaataagaatttaaaacggatacggccgaccactgcgccaacaaatagtgctggcgtgataatggcaaacatcatttgaaagatgagatataaaccgttgggaatctttgtcgcggtaagcgcggtcaagtccacaccatgcaaccaagtggctttgagattaccgacaaagccacctaaatcaccggaaaaagatagtgaataaccgaatgcgagccataacaagattgctaagccacaaatcatgaagacggataacatggtgttaacgacattccgtttggaaactaagccaccgtagaaaaatgctaatccgggcgtcatgaataataccaatatactagataacactaaaaacgttgaatttgcagcgttcatactcccaacccctatccataccatttgatgttagaaattataacattgattattgagtgacgcactctttttttgtgtttaggttaaatattaaacttacaaacgggctttggtgtcattatggaactgctgatgtcaggttttgtgacgcaaaactattgaaaacatgagtggactccttgtaaattcttagcaaaatccggtcaaagttgcttgttggcagaaatgtaggaagtgacttccaagagtggtcgcgattagttcggtaatgaaaataattaggcaatggggggcaagtgattaattatcttaaactaattaggggaattggtaactatagtgcgtgctattgcttaataaaatgatgatatgaaaggtgaggcgctttcagcaattgaccattactaactagagcagtaaggttatcaccacataaattaaaagacaatgagattattacataacgtcttaataattaaaacgggggttcagcttatgcgaaaatatgcgattattggggtcggccacgttggggcgaccattgcttatacattagtttgtaaaggaattgcggatgaattagtcttgattgatactaatgcggctaaagctcgcgcagagcaattagatttacaagacgctcaagcccgtttagatagtcgaacgattattaaaatcaatgactatcatgaattagacgacacggatattttatttgttactagtggcaacattcacgcgttagaccatgcttccggtaaccgatgggctgaatttgaatatacgaagcaaatcgttcaagatatcgctccgaaagttaaagcaaccaaatttaatggcgtggtcatcgatacaatgaatccgtgcgacgcaattactcactatttccaacgcgcaacgggattatcacgccaacaggtctttgggactgggactttcttggatacggcgcgcatgcaaaaggttgtcgcagaagccttcgactgtgatccaaaaaacgttagcgggtatgtttacggtgaacacggcgaatcacaattcagcgcgtggtcaacggttcaggttaacggtattccaattacatccttagttgataagtatgatttggacttagatgcacttgaggcagctgcacgccatggtggctgggcggttcattctggtaaggggtataccagttttgccattgctacttgcgcggttaaattaagtgaagcggtctttgcaaatgctcgcttagcatgcccggtctctgcgtatagtgaggcctttgggacgtatgttggtcagccagcaatcattggcaaagatggggtcgagagtgtgacgacgcttgctctgactgctgatgaacaagctaagttccgtaattcagcggacacgattatcgagaaattccacgcctttgatgacgtcttaagcgatcaatcagtaaaaaaacgtcaacaagcctaaaaagtgacggttgttaattgtcttgtttggcaaacttctaccaaaatgttaaaattttactaagcagaacgttgactgcattaactatatggtgggatgaatatgcgccgacaattaacaaaccggcaacggtggttcgtgattgtaatcgcgacgattctgggagtaggctgtgccttgcttggtcaatggggccagttcttcggagtcatcgcagcaacgtttgcgctaatgttgttaaccagtggctgtttgactttttgtcatcgccgcgggtggcaacctggaagcggcatgttgctagcattagtcacggctacagggtatgtactagttattttaggaagctatggttatttactgcacagctaagcgcagcactttgatacgaggaatcgaccgtatcaaagtgctttttgtctgcaatcatttttagcgtgctaattaagttatgtttcaacaatgattacggccatcggtgctcataaaaaaggtcgcgactcatcatcgcggccttcctgggtgcggtattgattgtaaacatcaaagtggggtcaccgcacccaaggtattaatggcagacctagttggatagctttacctaaagcctgccaacaggtaagcggtaacgcagatgcaccgccgcgctatcggctgcactaataccgttatagcgattatcagctaacatgacactgtggcgatcacggctgtgttccaaaccgatagtatgtcctaactcgtgttcagccacgtggacttgatccgtataagaatagtggtagcgtacaaaattacgtgttaacaagtacacttgcgcttttgtgtaataaccattggtataaccggtcgaaaaagtaataccagctaagcgataatactgcccactggtggcattactggtccccaaagtaatttgatgatgagcagtggttcccggtacgaatttaaagtgaccagtcgcattccaggcttggatggccgcttgatagacgtgccgctcgtatgatgatgctgaatgacgtaggtcacttgagcgtgtggccaacgactccgtgaatatggtgtcgcaatcgattttgcgttggcaattggtgtcagcccaagaccaaaaatcacggttaatgtggttaaacctaacttagcactgtacttattcttcattgttgtaaccctctttcccccaaaaacgaaggtcgccatcaataattgtattttaaaacgttgctgagataggggcctcatcctagacccgaatttgaccaaaaatcgcgtgatttggttgcgattaaagttagttaaataggttatcgcgtgctatgatgagaatatcttatgatgatggaaggaaattgatatgacgattaaacaggcaattgttcaacaagctttgacgttaataaaaccgcaaatggttgttggttttggtggtggctcgacggttggtgaactggtcaaggaggcagccaatcatgtgaatgatattacggtcgtcaccccatcaccgacgacccgccagcttgcgaccgttctcgggtataccgttgtagatactgcatattgtgaccgggttgatattgcttttgacggctgcgatcagttagatcatcacggtaacgcgctcaaaagtggcggtggaatccatgctaatgagaagattattgccagtttggcggatgaatattggctgttaacgatgcaggaccggttagtcgatcaatttgatatcaagacgccattagtcttagaagtactaccagcggccttatcgttagtcatgcggacggtgagtgatcttggcggtcaggcaaccattcgaactgctaataatcgggatggcttcacgttaaccgatagcggcaatttattgatcgattgtcattttccaacgtatgccaaacttacggacctgaatgttgaattggcaactttggctggcgttgttgaaacgagctattttgatcatttggtgacgaatgcttggttgggcgatgcaaccacgaatacagtcaacgcgctattttaagtgttatcagggacgacagcatgaccctaatgattagcaattgagcactgaaattcgtttgacacttttttaaaataattctaaactgaaggtgacgtataaaagcgccaccattttttgaatctaagttattttaaatatctaaggggatgtcaacatggcaaaaaaagtctatactgattatttttttgatgaacctgcttacaacacacatgacggtggctatattccactagttacaccgaaagtcgagccacaaccgttagcgattccgccgttattgaagccggaccgccagacggatacggatgattactatattgtcacggcgcaagaaagcgaaactcagtttttacctggtaagaagactaaaacgtggggctataatgcgggcttcctaggccaaactatcgtctttcgtaatggtaagcagacccatattgacttggaaaataaactcccagaattgacgactttccattggcacggcttgaatgtcccagggcccattaccgatggtggctgccacgcaccggtctatcccggtgaaacgaatcacattgactttaaagtacatcaaccagctgcgactacgtggttacatgctcatccgtgcccatcgactgcgacgcaggtctggaaaggcctagcaacgatggtgattattaaggatgacgttgaagatcagttaccgttaccacgtaattatggtgtggatgatattccgttggtattacaagaccgtgaatttcacgatgataaccaatttgattaccgggcggactacgatccagatggtgttcaagggcatacggcgttagttaacgggacggtcaacccatattttgatgtgacgacgcagcgggtgcggctacgaatcttggatgggtcgaaccggcgcgaatggcgtctgcacttcaatgacgatttggaatttgcacaagtcgcttccgatggtggcattttgccggcaccggtttatatgactaaagtgatgatgacctgtgcggaacgggacgaaattgtcgttgatttcggtcagtatcagccgggcgatgaagtcacgctgatgacggatgatacgccgctatgtcgcttccgaatcaagtcgttcgtaccggatgacaccaaactaccagaacatttagttgatattcctgatgaaaccccaacacctgacttacctgttcgcacaatcacgatggatgggatggatgatgaagtcgcgctggatggtaagaaattcgatatgagtcgcatcgacgctcggcagaaagttggggatgtcgccatttgggaaatccgcaacaccaacagtactgaaaacggcatggttcatccattccacgttcatgggactcagtttagagttttggcacggaatgatggtccaatttatcctaatgaacatgggctgaaggatacggtcggtgtcaaccctggtgaaacggtgcggatcaaggtcaaatttgagctgacaggagtttacatgtatcactgccatatcatcgaacatgaagatggtggtatgatggcccaaattgaatcatatgatccccaacacccacaaacttatcatttaatggatatggacaccttacggaatgcttttgcgaaggaacaaggcatcaagcccgaagatgtttggatgcccggtatgtaagtgtagattaagctaatttagtgatgagatgtgaataaagtccggttgcaaccagcaagttatctgcttggtcgtagccgggctttatcatttaaaagcacctcggggtcaaaacggtggcggttttgaccccggatttaccatgttttaatcatgatttgtgacgaattagctcgtataaagacaagtaagtctgtatttctacagtttaggcgcagtaactggtacaattcaagtaaggaccgaaaaaaggaggggattaggatgcacgttgcagcaatgattatggcgatcttggttgccgttgaacatttatttattttgtggctggaaatgtttaatgcggatagtgaaatggccgcaaaagcgtttggaattccacggcaaacgctacagtcgccgtcagtgcaattattgtttaaaaatcaagggttatataacggtttcttggccgtcggtattttatacagcttgtttgtgattccggccgtcgcgagcgccggtgcaaccctgtttttcttagcctgtgtgatggttgccgcggtttatggtagtattactgtcagtcgcgcgatcgtcgtgattcaggggctaccggcattaattgcgtttattctgatgtattttgcttagccggttctttgaagtaatgccattatattagtgttaataaaaaacgttgctacgtgattctgtagcaacgtttttggttgtttaagctatccatattatatggcagattggattacactttgccaatgaccgtcgttttagcagttgctagcacgtgaccggcaatggcatcatgaaattcgttgagccagtatccaggttggaggtctaactcagtatcaagtgcaaatagtttaaatgaataacgatgatccttgtcaggcggatacgggccgacgtagtgttggctaactttcggatcagtctcgtgaacataggcgcccgctgtggaattattaccttggaccatcggaatagcaccggtctgactggcattttcagggatgtgggtcgtggttgccggtaaattggcggcaatccaatgaatccaggtgaagccacctaccggaattgcatcgtggtcaacgaaagtgaacgccagtgaatgggtgccagctggcacatcactaatgtcaacgggaaacgagatgatggggtggcccttatacgtttgggcaacggccgcttgtttggaataggtggctgcaagggcgccattgatggtcggaattgatagttgcattgcaaatccctcctcgtgtaattagtcttattataacgctaatagtcgctggcgtagtgctgggtcaaccgcataaatataaagcccataacgaccacgtttcatcaagacgttgattgagttaaagataatctgctgtttaaggggacacagatcgcctaagtctgtccggtttttgaacgcttcttgatcttcatagcgttcagggcgaacgacaatctgatcatggtcttcatcatagcccacagaagggccgagaatgacccccgcataattcaaatcaaacccttgaatggtataaatagaaccaacttcattcagtgtctcaggtcgtaaggcccaaggatcatcagttaagttgactttatcccacggaagcttcaattgtccggccgtcacgtaccaagtgccatgattaacgacgtacgggaagtcagcggttgccaccatccgagcgagtccatactgctggtcgcgttgtttgatcaggtcgtataagggttgcccgtcatcaaaaaagcgtagatcaaagttatcgctaacgggttttggttgtaattgcccgcgggtaaaaccatcgatccagtcgacaacatcggcgccgccagtgacccgaaattgctcgtctaagttgtagttcgcgtgcgggtactggtctaaaaatggcttgagatcgttgctgtgccagtagctctttaacttcaagacttgacgggtgtcgaagacgaggacaacgacgcgactatgattgatcagttccgttaactggttgtgacctgtaaagcggttatagcggtctggttgcgtgagtaataggtgcgcttcgtcgataaaaacaacgtctgcttgccggtgttcttttgccaaccggttgatcaacggagtgggcttttggaagtcttttttgcgcaagacgggatcttcactagctaagcgcttataaattttgagcatttcattgtgattgacgacgagatagttgtcagtggcctgcaaatcgtttggtgtcaagctacgattgagggcttgtagccgagcaaacgcggcggctaatacggcactcttgccagttcctgcatcaccatgaataacaaagaggctgggctgtttttgctggcgatgggtacggataaaagttaatagttggtgctctaatgattgttgtgccggtgacaacgcagcttgatcatttagcttgaacgttgcggcactgattgtagatgacatattttttcactcccaaacacattatacctgcatattggggctaattgaaatgagagtcattacagttggtggtagaatagaattatgacaaagtgtgggaggaagtaacatgaaacttgatttttcggtggcggtgcatagtatcctgtaccttgatgcacaccgtgatagtaaggtcgctagtcgggaactcgcgcagtcactgcatcttaacccggtgatgattcgtaatattttatcagttctacataagcatgggtatttaacggggacggttggtaaaaatgggggctaccaattagacttggcgttggccgatatgaacctcggcgatctatatgatttaaccatccccccaacaattagctatgcgcgcttcattacgggaccatccaaaacggatgaacaggctgatcaatccccgattgcggccaatattagtgaaacgttgacggatttatttacagtagctgaccgtcaatatcgggcttactatcatcagtttacaatggctgatttacaagccgacctgaaccaccacggtacgtttttacaacacgaacaagattcagaatcttaagtaaaaagcgtcacttgattgaaaaataaggcgattttcgttaataaccttaatttgaaacgggtttgccattcaggattgtcagggctaattatcggtgctatcttagatgttattatgaaagtggcattgagattgaaaggggccttggcaatgacagcacggttagtgttaattcatgaagttggtcgttatcgagaattatcggaacaacggtactggttagaatccgccgatttttggggtgtcgatgggcgtggcgcgacggtcaatgaggccgtcggtaactttttgaccaacctcgtgcaatattgccgcgactattaccaacgcggcttgtggcaacttgatgatcggttgttacagctagaccacgttgatacagtgttagcgtacgcgcaggcaggtaagtcaccagcaccattatttttgtttaaattagttccggcggatcatgagttggcgtctgcttaaacgaaatattgacgaattcttaaagaagcgttcatacttccaccacactcctgcgctaaactatgcgttataatcaaagcgtaaattaattggagggtgttgtatggaattagataagatttatcagttaatggacaagtttgaacaaagcagtttaactagttttgagtatcgggaccaagattttgaaattcaaatgggtaagaagggacacggcaagacgacggtgaccccgcagccggcgccacttcccaatcagccggtgattgacccaacgccggtcacaccgacaccggtctcaacagttagtaccccagttgttgcggaggcggaaccaaccccagtggcgaccagtacggctagcaatccgacgagcgttgtaacacctgatcctgaaccagaaccagcgccgattgatcctaaggaatgcgtgacggcaccggtcgtaggaatctattacccagcgcattcttcagaagaagcgccatacgttaagttaggcgaccacgttagcgttggtcaacaagtcggcctcattcaagcgatgcagatgatgcggccagtggttgctaagcaagcggggacggtcaaagccttcctagtgaagaatggtgaagaagtcaacttcggtcaaccattgattcaattagtcccagatacgccggatgacatttaatcaggtacggtcagtggttgctgagcgtattaagcactttgagtagcactacgttttgataaaagcgtaacgcaaactaaaaatgaaccacttcaagcgcacatgataattgtgcaagctgaagtggttcattttttagcttaattaatgacgattggtagtggtttatttaggttggtcaatggctgccacggtttctaggaaccacttgttgaaagcagccgcatcaatatcgacacaaacggtcgcgttggttttgccgtcatggtaagcaccacgaatatcgccaacggtctcgccattagcggggccctccgtctggacatcaatccacatcttttcagtcgtgaaggcttctggatgtagtaagtagaagagcgtattgacatcatgcatcgcaacgccagtctggttgcggtcgttgtaatgaccaaagagggcgtggagcatttcgccagttttaccgagggtcggtaactgttcaatcgattcgcgcgttaaaagggccttcatcgtcacgtctaagccgaccatggtaattggaacgccggattggtacatgatttcagccgcgtgcgggtcggtaaagacgttgaactctgcggcgctggtcatattacctttgcctaaggccccacccatcgcaacgatttctttaatgtgtggcattacttcggggtaggtcttaaataagagcgcaatgttggtataggctcccgttggcactaacgtaatcggttgttcagcagccatgatgtagtcacggagcgcttcaacggctgtttctggtaatggttccgcaaggtcagtcgggaagtcgtaacccggcattcctgaaacaccgtgaattcggacggcatcttcaaacggtttgatcagcggttgggcagccccacccgctacgggaacgtcactgttaaagaagcgcgttagtttgagcgcattcagcgtcgttttgtcgaccgtcacattgccggcgaccgttgtaattaattgtaagtccaagtcaggatgatttaacgcaaaggtaattgcggcggcatcatcaataccagggtcagtgtccatgataatctttgttgacatgttcattcctccaattaaattgacgtgcttgaaattagttctattttagcatactacgggcaatgaattcgattgcaattgtgaagggtttgacgtagcatgacagtaaatacagttaacgatggaggaacggattatgagtcaaccacgggtcatcttaattacgggcgcatcttcggggatcggtaaagcaactgctttgaagttacaagctcaggggaacattgtgtacggagccgcacggcggattgaaaaaatgacggatttagcagcggctggagtgcacgttttaaaagtcgacgtgacggatgaagcgacgttaatcgcggctgtcaagacgattcaggtcgaacaggggcgcattgatgtcctaatcaacaatgcggggtatggctcatacggttccttggaagacgttccggtcgcagaaggcgagtaccaattcaaggtcaatgtctttggtgtgatgcggttgacacaattagttttaccgttgatgcgggcacaacatcgtggtcggatcattaatgtttcttcaattgggggaaagatctatcagcctttaagtgcttggtatatggggaccaaacacgcaattgaagggatgagcgattcgttacggatggaagtcgcaccatttggtatagatgttgtcatcgttgaacctggtggaatcaagactgaatgggctggtattgcggaaaaaaagctgttggcagtttccggtgagacagcctatcatgaacaagccgttaaggtcggtgcgatgctgtcattgttcgatcagtttgcttccaatccgggagtgattgctaaactgatggttcgcgctgtcaatgatgtgaagcccaagactcgctatcacgcaggtatgggcgcgggggtctcattaacggctcgtcagtggttgagtgatcgtcagtttgaccgcatgatgaactcagccgtcaatggtgcggctaagctgtcaaaagttacgcggcgtaaggaccggcgaaccgggagtcggcattatcggcatggaaaaatacccgctgataataattaatctgaataatgatgctaagaagcgagcccaacgatcacagttgttattgtggtaggggttcgcttctttatttcaagtctaaactttaagcttcccccatgtagcatgggagagatagggtctcgttagttattattttagctggtgcttggatgatgacaagcaggtggattcttgttcggcagcaatgatcgtcctattccnnnnnnnnnnttcacttagcaagcgtcttgtgcttggttagtgaaaggccagtatttgagacgtggtgtttcggcttaaatctgtgcccaccacgttccggcaattggcagaaatgcctggaagtcggtgtaggacgaactaaccaaacatgtttacgctaacccgaacttttccagcgggcctaagctggctgctttggacttaggtttgcaccgccattatagcttcgtcatcaccgccgttagcgtagtcgttgcggtggtcatcgcgggatcgtccacggggtggtaggtgatggtgaggttgggaaattcttcgataatgggaatcagcgtttgccattggggtaggtctggctggtcggcttcgggaacgtcccagttgttttgccgccagcttaaataacgttgttcgctaataaccgccgccacttgttcagttgtggtgtgaacatgaacgggtaaatcatgacgtttcaacgtggcgagtgcggtggtcagagcactcaaggccagtgaagtttcggtatgtccgtagccaccgtcgtttagcgccttttgatggtcagcgtatcgcagaatgacgacccaggcagcgggggttgttgcggtgatgttggtcgattggtggttggtacttgcaaggtaaagatgaatcgtagccattgttggggcctccttagttgtaatgataatccattgagtggttcatctaatagtttcgtaaaaactagccagcttcattttaaattaatgaataactttaacatgaaactacaatagttacaaaatttagtgaattgtcagtgcgtattactatgatttttggcggattatgctacgattaaatacatggataattaagaagttattaagtaataaaggtgagcactggaggttagcatgcagacattaatacagacgtttatggatcgacgcggggatttgctgactgcgctatggcaacacttggggatttcattagcatcattagtcatcgcaatggtaattgcgattccgttggctatttgggtcgttcgacgaccacggtgggccgagggattgttacagctcacgagtgtcttacagacgattccgtctttggcactgttagggttattgattccgttagttgggattggaacggtgccagcagtaattgcgctggtgatctatgctttactgccaatttttcaaaatacttatttgggtatctcagaaattgacgcctcaattgaagaggccgccgatgcctttgggatgtcacgaatgcgtaagttgtttaaagttgaactacccattgccctaccacagatcattgctgggattcggaccgcgctcgtcttaattattgggacggctactttggccgctttgattggtgctgggggtctcgggacctttatcatgctcggtattgaccgtaatgatacctcgttattattgattggggctatctcatcagcattgttagcaattctgctgagtgcgctcgttcggtggtttcaaacggctaaaccacgccacgccttaatcgtctttgtcggtattttagctttactaggtggtggcggggcttatagtgtttatgccaatcgagttgaaacaattacgattgcaggtaaactcggttccgaaccagaaatcttgattaatatgtataagcagctgattgaagctgaagatgagcatgttcatgtgacgctcaagcctaactttggcaagaccacgttcttattcagcgcgttaaagaataatcaggttgatatttatcctgaatttactggctcggtgctggagaccttagttaagggaaataacccagctggtcaaacagctaatcagacctatcagctcgccaaacagcgcctcgctaaacaggaacaaatgacttacttgaagccgatgcagtataacaatacgtacgcattggcagtgactaagaaatttcaacaagaacatcatttgaagacaatcagcgacttaacgcaagttgaatcgattctgaaacccggaatgaccctagagtttattgatcgtaatgatggcttaaaaggaatcaagaagacttatgggttagacgtgactgccaagtcgatggagccggcgctacgctatgaagccatcagtaaggggaaaatcaacttggtagatgcctatgcgacggatagtgaattacggcagtatcacttggccttattgaaggataacaagcacttcttcccaacgtatcaaggggcaccgttgatgaagacgaactttgccaacaaacatcctaaggtcgttaaagcgttgaataagttagcaggaaagatttcagaaactgatatgcaagaaatgaactatgaagtcaatgttaagaagcagtccgcttcgacggttgcacatcgctatcttgtgaagcacggcttattgaaggagggacgttaaatgacaacggcaattgaatttcaacacgtccagaaagactttaatgggcagaccgtgattcccgaccttaatttaacgattgaccagggtgagctatttgttttggtagggacttctgggagtggcaaaacgacgtcacttaaaatgatcaactgcttagagccactgacggctggtaaaatcctagttaatggtactgatacaaccacgataccagtccgaagtctacggtggcaaatggggtatgtcttacagcaaattgccttgttcccaacgatgacggtggcgcaaaatatcgccgtgattccagaaatgaaagggacagctaagaaggaaattaatcaaacgattgatgagctattggcggaagttggcctcgatccaaaggaataccgtgaccggatgccgtcagaattatccggtggtgagcagcaacgcatcggtatcttacgggcgattgcggcgcaaccagatattgttttgatggatgaaccatttagtgcgttagaccccatctcgcggcaacaattgcaagacttggtcttacggctacacgcccgctatcacaacacgatcgtcttcgtgacgcatgatatgaatgaggcgttgaagttgggtgatcggatcggtgtcatgcaacacggtcagttaatacaagtcgatacgccggctgctctggctcagcatccagtgaacgactttgtgcggaacttctttggcgcgagccgagctaaaaatgtctatgatgtctacgttgggcgtgtagggcttattcagggttatctcacagaagaacccagtgttgcgagtggtcggattcaatcgttagacgttcaagccacgttacgcaccgcctttacggcattgacagatcacgattatgtggcggtcacggaagaaaatcgggttgttggctatttggatcgccaacgaatcgtggcttacttgagtcaacatgaagaagtatcttaatcgtcaattaaggatgaatcagttacactaggttgtgataattgatggtcgctaatgaatttaaggaggaatttcgaatggcggaacagtacgatgttgttgtgattggtggcggaccagccggcaatgccatggctagcggattaaaggcccagggcaagacagtgttgatcgttgaagcggatctgtggggcggcacttgtcctaaccgcggttgtgaccctaagaaaatcctgttaagcgccgtcgaagcgcgacaagcggcgcaacatttacaagggcagggcctgattggcgcgcccaaaattgattggccagcactgatggcgcataaacgaggctatacggatggcatcaacgatgggacgttgaacggactaacggggcaagatattgcgacgttacatggccaagcacactttcaatccgacaatcagttagcggtcggggatcgagtagtcagtgcgactgattacgtgattgccactggtcagcgtccggcgattctaccgattaccgggcacgaatactttaagacgagcactgacttcttagatttggaccagatgcctaaacgcgtgacatttgtaggtggtggctacgtaggctttgaattggcgacgattgcgaatgccgctggcgctgatgtgcacgtgattcatcataatgaccgcccgttaaaagcttttgatgcagatttggttaaggatttgatggccgcaatgacggctgatggaatcacgtttgacttgaatacggatgtccaagcaattactaaaacggcgaccggtctacaattgacagctgataatttcgagctgacaacggatctggtcatcagctcagcgggacggattccgaacgcggaccagttaggtctagccaacgtgggcgttacctttgatcggcatgggattcaagtcaacgatcatttgcagacggccaacccgcacatttatgccattggggatgtcagcgatacaccggtaccgaagttaacgccagttgcaggttttgaagcgcgttatctggtcggtgagttgacgcatcccggcgcagccataaagtatcccgttgtgccaacgcaggtttttgcagcgcccaagttagcgcaagtcgggatcagcgcggccgtggcgactgagcatccagatgagtatcgtgtcaatacacttgatatgacgaagtggttcacttattaccgctttggcgcacaacaagcccaagctaaagtagtggttgctaaagcgagtgggcaggttgtgggtgctacccttctaagtgatgttgccgacgagatgattaactacttcacgttgttaattgaaaaacacgtgactttaccagatttacaacggttggtattggcttacccaacgccggctagtgacttacaatatttgtattaatgtgtggttgaattaaatcaaagtccagctattcagcttaactgaatatgtcagcactaacggagtgaccaggaatgaccggccactctttttttgtttgaccggcgtttggagtggaatacgaaggccaaatgatgtcgcaaacagacggtcgtcattttcgttgtgcgactatcttggcgtgtaagtactgtgaaaaaatgtcaaaattgtagctcgtcgcggtggcactaatgttagcaaattaattattttatagaactagaagcgatcgcttaaatgctacgatgcttgctatggcagtatcgaactgtgacatagtacaaactagttttaaagtggcaaattacaagtttaatnnnnnnnnnngattaattatagaatttgccaagtaaattcaattgtgcaaaatttaatttatgcaaatctattcacaaaacggtcgcgacatggtatgattcaatcatcaattatgatagcgttttcataaaactgttatgactaaggagtgacacaccatgaccgacaagtacattatggcaattgacgaagggacaaccagtacccgcgccattatctttgaccatgcgggccataaagtggccgactcacaacgggaatttccacaatatttcccgcagccgggctgggtcgaacataatgccaatgaaatctggaatgctgtcttgtctactattgcgaatgccttcattgaatcgggaatcaaacccgctcaaattagtggtattggaattacgaatcaacgggaaacaaccatcgtttgggacaagcaaactggcttgccaatctataacgcaatcgtgtggcaatcacggcaaaccgcgccgattgctgagaagctggttaaagatggctatggtgatttgattcatcaacatacgggactcgtcacagacgcttacttctcggcaactaaaattcgctggatcttagaccacgtgaagggggcccaagaacgagctgaaaagggtgaattactctttggaacgatcgatacgtggctcctatggaaacttaccggtggggccacccacgtgacggattattccaatgccagtcggacgatgctcttcaatattcatgatttgaagtgggacgaccagattttgcaattattaaatattccagcggcgatgttgccagaagttcgcactaattctgaagtttatggcaagaccaaggactaccatttctttgggtcggaagttccaattagtgggatggctggtgatcaacaagcggccttgtttggtcaactggcgtttgaaccgggaaccgtgaagaatacttacgggactggggcttttatcgtgatgaacaccggtgaaaaaccccaattatccgataataacctattgaccacgatcggttacggcatcaacggtaaagtgtactacgccttggaagggtcaattttcgttgccggttcagcgattcagtggttgcgtgatgggattcgcctggttgaaagcgctcctgattctgaacgggcggcgcgcgaatcgcataatgaaaatgaagtctatgtggttccggcctttactggtttaggggcaccatattgggactctgaagcacgtggctcagtctttggcttgacgcgtggcacgactcgtgaagattttattaaagcaaccttgcaagcattggcttaccaaacgcgggacgtggttgaaacaatgaagaaagattccggtattgagattccagtattaaaagttgacggtggcgctgctcgtaatgactggttgatgcaatttcaggcggatatcttggatacgcaaattatgcgggctgctaatctggaaacgacagcgcttggtgctgccttcttagccgggcttagcgttggttattggcaggatttggaagaattaaaagcgtcgtataagcccggcacgagttttgaccctgagatggggccagctgaacggacgaacttatacgagggatggcaggcagcggtcaaagcgacccaagtctttaagcacaccccataccacgcaggaaaatagaggaggacaacaacatggcattttcagcaacgacgcgtcaacaaaatattgaacgcttacaaaatgaaacgttagatttactcgttatcggtggtgggattaccggtgccggtgtcgccattcaatcaactgcaatgaacatgaagaccgggttgatcgatatgcaagactttgcagaagggacttcatcacggtcgacgaaactggtccatgggggcattcgctacttaaagacgtttgacgtgggggtagttgccgataccgttaaagaacgggcggttgtccaggggattgcgccacacattcctaagcccgacccaatgttattgccgatttatgatgagacgggagcgaccttcgacctcttttctgtcaaagtggcgatggatctgtatgataagctcgccgaagttaaagatcctaaattcaccaattataccctttcacgcgaggaagtcttacaacgggaaccacagctgaaccctaaacatttagttggtggcggtgtttaccttgattttcggaataatgatgcgcgcctagtgattgaaaacattaagaaggctcacgaaaatggtgggattatggcaagtcatgtgaaggcgaccggcctcttacatgatgatgatggccggatcaatggtatcaccgctgaagacttattgactggtgcatcgttcgagattcatgcccgaatcgtcatcaatacgaccggtccatggtcagacaagattcgtaagatggaccatactgaaaagtatcaatcccagatgcggccaaccaagggtgtacatttagtcgttgacgctgagaaactcccagtgccacaaccaacctattttgattctggtgatcaagatggccggatgatcttcgtggtgccacgtgaaaacaagacgtatttcggaacgactgatacggattatcatggtgatctgaaacacccgaccgttacgcaagaagatgttgactacttgttggaaatcgtcaaccgtcgctttccaactgctaaaatcaccttagatgatattgaggctagttgggccggattgcggccactgattgccgctaacggtagttccgattataacggtggtaattcagggaaaatcagtgataagagcttcaaggaagttatcaaggttgttgatcagtttgaaagtcaggaagccagtcgtgaagatgtcgaaagtgtcctgaatgacttggaaacttccttggcagaggacaaactcagtccgtcagcggtgtcacgcggtagttcgttgactagtagtccagacgggctgttgacccttgctggtgggaagattactgattaccgtaaaatggctgcgggtgccatggcgctgattgccaagattttagcagataagtatgatgcccactttaatgaaatcaattcgaagaacctccccgtttctggtggcgatattgatccgcacaacgtggatgcaacgattgcattttatgctaaacaagggacggataatggtttgacgaatgatgaagcgttgcggattgcaaatatgtacggttccaatgctgcgcgggtctttagtttgattggtaaagttgaaccgacgcatggtctgagtttagccgaaacgattagcttacgttatgctttggatgaagaaatgaccctgacgccagtcgactacttgctgcggcgcactaatcacttgttattcatgcgagatacgctggatggcttaaaggatggcgtcatagcgacaatggccgattaccttggttgggatgctgcaacggtcaaagcacaaaccgaattattgaatcagacgattgctgaatcggacttaacagcactgaagcagggctaaggaatggggtggtcatgatgaaagatccattagcactacaattgttgggggaatttctcgggacctttatcttgattctgttaggtgatggggttgtagctggggtaacgctcaataaatccaaagcgcaaaatgcgggctgggtcgcgattaccttaggttggggatttgcagtcacgatgggcgtctatgcgtccagctttatgagccccgcacatcttaatccagcggtctcactaggaatggcagtggccggtaagttcccatgggcctacgtgattccatatagtgcggctcagattgctggtggggtgattggtggcctcgtggtttggttgcactactacccacactggcaagcaactaaggatgctggcgcgattctcggcatttttgcaaccggtcctggtatccggcgatatttctggaactttatcagtgaagtgattggaacgttcgtcctagtctttggcttgttagccttcacgaaaggccaatttacggcgggattgaacccgattgttgtcggaattctgattatcgctatcgggctgtctctgggtggaacgaccgggtatgcaattaacccggcccgggatttaggtccccgcattgcgcacgcggtattgcccatcgccaataaaggaacttctgattgggcctacagttgggtgccaatcgctggaccattggttggtggcgcgttaggcgcactgttgtttaatgtattgccataattttatgactgatttgatataaaccgtgaggactgttggaattgacaacggtcctcacggttttatttgtgagtaatggttgaaattcatgctttcattaactgagtaaaacggcaatagataagcagactaagacgtcgaataccgtcaccaataccattgacaatcaagcgaccatcacggtacatcattacatgaccgattctactgataaagttgctcctgatgaaacagtcaaagttggttacgggaaagcttatgatgttactaagcaggtcaaaacgataactggatataagcgtaatgccacattggatgaacatacccgtggcactgctagcaagactaccaaagaagccgtgatgtattatgatccgttgccatacaacattcatgtcaattacttgttaacggatgggcagaagctggacgaattggatgtcactggtctatatggtgatacttacacgactgaggcaactgatttcgaagatttgtacacagttgatactgatcgcttaccgacgaatgcccagggaacggtaacggaaaagccaacaacggtcaattattattaccaaccaacgactgggcagtgggttgacgttggtaatcaaagtagtgttttagtacgacaagatacgaagcataatgtccgttctgtctcgcagatttatgccaacgatagtggctttacggtcaaatataatcaggatgctgctcaagttgcgattgcggctagtgatacaaacggtacccaagataacagcttagtctttgattataattcgaagtatacgtttgaattatctaagaatgagactgtcacttttaaggttgatgatcaaggccaagtgactgcgactagagtgttaggcgcagagcaaacggtcacgacttttgataaaagtggtcagcttaagacagtgaccacggtgactaacgcgaatggcactaagagtcagcagaccaacacggttgacgggttgaaatcaatggtgactggcgaacaatacgacttaggattgttgaatgggttgaaagttaccgcacaaaaagaaatcaatccgagtcaagcagcaacgactgagtccaagacaacgactgatactagtcagtctggtagtaatcagtcgacaagtacgacagcgactgaccaaactgagactaatgaatcaacagctggtagttcgaccaacgcaacgaacgcgtccagtagtgtcgatgcaagttcagcgaatagtcaaggcgacactgaggctacaagccagtcgggtactagtgcaagtgctgattcaaagacggatagtagtgcggcatcgagcactagtcaaactactgacggtgaaacaaccaataccgatgatacgaccactggaacaactactgacagtggactgggtttcaagtcaccatttactgaggatcaaaacacaagtagtgcactgggcagcgcccaaacttcgagcagtctcaatagtgatacgagtgcagcggtacaagcattgattgcagaacccaattccacgccggttgtcttgggtgaggacgcttcttttgaggaaggcgtgccagtcaatgatccggtattcagtaatgatgaaggggtttcgccgaacaacaatccaagcagcgcagcaacgccccttgcgcaagctacgaatacccgggcgcgtctgactcaaaatggcaaactgttatatgaaggaacgctgcaggctgatcaaggggaacagaacctttatgtgtcgccagatacaaccgttgaagttgatggtggggccgatggtgacggcttttacctagatacctatgatggtgataagggaatggcctatacattgggttcaggctatgcgtgggcagccgaaaacaatgatgtgactgcggcaccagcaagtagtgcgacgaccagctctgagagtgctgccagtgagtcgagcactaatagtagtgatagtagccgtacagcttcaagtgcggccgaccattcgactagttcggcaagtattagtgatgcgagccaatcaagtcattcaactagctcaagtgaaaatagtcgttcagaaagctcatcaagctcaagtacgaccggtgattcggctgacgcggataaacaggccgcagctcgttccagccaaactcagtcgaatagtgttaatggtagcagtcaagcagtaggctctagcacggtcactagtcaatcgtcagtaccaactaaagctaatacgaagcaggcttcatccacgccaacgaccaaggctaaccgagcaactgtcgtagccgctaccagttctacagcgccacggcagtcgcgggctacgacggcaagtgcgtcagttccaagtgtaacctcagcaagtgctgcggcggcaagtcgtgctaagcaacgatcggcgttcaagaagcaacatccaatcttgaaccaaattttgcctaaaacgaactccgcggtcgcgacctggttggtctggctaggagtgggtttattgatactcacggtagcgattacgatggttattaagaaacgagggcgtgactaatatgataaaattacgccaggttcttaaaaaaatcctcattggcctaatggtgtttgttctagttttcacggctttttccagctcggtcgacacagtctccgcacatcgccgtggtgtgacccacactcggaagcataaggtgcgacatagcgctagtggtcacgccaagaagtctcatcgtgcacatcgcaaagctaagcgcagagtcgtccaccgtaaagcaccgcatcggcggaaagttgcggtaaggcataagaaaaaaacgccaaagcgtcataaaaaggcgcataagaagaaggccgctaagaaacataagaagtcgcacaagaagtcacacaagaagaaagcggccaagaaacataagaagtcgcacaagaagaaagcggccaggaaacataagaagccgcacaagaagaagtcttctaagaagcatggcaagtcgcacaagaaaaaatcttcgaagaagcacggcaagtccaataagaaaaagtcttccaagaaacacggcaagtcgcacaagaagaagtcttctaagaagcacggcaagtccaataagaaaaagtcttccaagaaacatggcaagtccagtaagaagaagtcttccaagaaacatggcaagtcgcacaagaagaaatcttccaagaagcacggcaagtccaataagaagaaatcttccaagaagcatggtaaatccagtaagaagaaatcatctaagaagcacggcaagtctaacaagaaaaaatcttcgaaaaagcatgcatccaaaggtagtgctgtaattgccacgcttagtcgtaagaccggtatcagtaaaggcatcatttcgcttttgacggatctagttgggtataatgatatttataccatgattacgggaaaagatgccgctaccggtaagaagcgctcgcggttggtaggagcggcttggacagccttgaactttgtgcctgtctcgaaagtcgctaagttagcaaaggccgcgaaggttctggcaactgctaagaaggccgagaaagttgcgaagaatggtggccggatcaaacgggccgcccgagcaactaaactggcgacaaagcgagcggccgagaaactagctaaacgaaagcccgccaaaaagactgcgaaaaaggcagctgagaaggctcgtaaagctaaaaaggtcaagactgccaaaaaagctaagcatcaacaggcaaagcccaaaaagacttcccatggcacgaagcataaaacgaccaagaagcagcagaagcgatataacaagaaaaaagctgcgggcaaggctaggaaagcttcgtatgcacggaaaaagggcggtactaaaaagaagccgggcaagcgtaagggtgctaaagctaagactacaaaacgaaaggctaagaataaggtaaaaaaggaccataaggctaagaaagccagtggggctaaagggtttaatattgacgaaattcatcccaaattaaaaacagagccagatactgcattcttttggtctggtagaacagatggcgttggtggagctgacatagcggctgatgtagctaaaagtaaaggtggcgttactttagaatcaacaataggaaataaaaatattaaaatgccagaatgggactttaataaacctgagtcaatgaaagcttgggatttggcttctggttcgtatgcagaacaagtttctggtgaagttcgtgcggtagttggttcagagttgagaaaagggaatatttgggaaaacgttgagctacctagattaaaaaataatcctaaagtaacgaaaataacaacgattgatcctaaaacaggaattgaaaaaataatttttgagaggaagtaagttaaatgaaaattacaggtagtagttcacatgtgaaatttgatttggagaatgagtatgcggtgaaggcagagggagaaatgttagtgggaggtcaatttgttgtattcaaagattctatgaagaattgggaaccgccacatgaagatgaaaagctttccgaagctgaagtacaagaaattattcaacaggtaaaacagaatacaaatgaaaacacagtacaaatttcatttgaataaaaaagtattagaattagagtaatcggttaattctgtgaggtaaaacaacttttaacgaaggaattaggtttttaatacgctattttgctagattttgagggcgaagtagaaaagattttaaagaacagattcaaatgctaaagcaaacgatgggcatgttatgctgaaaaggctcgaggaacaagttaaagtgctagctatttagtgagttcctcgggcaccaacaaactgactttctttatagtgttttatggattagaagagtcatttttctcattttcttccgcttcttgtagaagcagaagcaaacaaaatagttcggttgaagatccagaacgttgatgaaattacgcgttctggacttttagactgttaccagtattaatcaaggtatcatttcatgtctaacggatctagttaggtataatgatatttataccatgatcacggggaaagatgccgctaccggttacaacttggtcacggggacacgatgatactttgcttagggtccgcgatggtaaaataactgatggtggtattaatagtcgaccagttcctgctatgaaagatggaatgcataaagtttcttggtatatcaagaatggagtgaagttaccttgacaaaaagattaagtgaacaggaaagttacttttcaatgtctgagtttttggaatcctactattgggctagtagagacgatgatcttggaagtctattggggagtgtcacactttggagtgatgatggggaattgtttgatcaggcaattgcggaagactggcatgctttctttagcgacgtgagcaacgaaaatcacactgtgtttgagagttttcaagctgtcaagcagtttgtgaatgagtatttgccggatatcgcagcaacgacaccagtatcaggaagcttgacgtataacattagaataatttgtgagatgacagaatctcaacgaaatcaggaacccgtgtggcaaaattgggtcgcagctgttaattggattacgaatccgaatgttgtgccagtcaatgaatcgccctttcttaaaacggggcaatcattgcctaatccaaaggaaaagggttttcggcaaaatcaatttccaattgccaaggttttgccagcgccacgaccagaaattccgatggggcccagtctggaaaaggtggacttgacacagtcgtattatgcgtttgtgaaatttttacagcattattatcaggttagtgatgatagtgaattgggtaattttttgcagcaaaatagagctatcagtgaaaataatgaagaatatcgctattggaaggggaagttttcgagatgctctggtaataaaaagctattagatattttgaaggccttcttaatggtaagggattattttgaaattgaatttccggacaatgcactgcatacgcatcctgtacgtaaattgagttgtaatctctggaaggcagcgtatctgccacacagccaacgtattcagactgaggtttggcagaattggttaacggcagttcatcaagtaatagagtaagtgacaatgtcatttgataatcagttgagttctcaatttaaagatcaagaggatagttataatgcgattattttgttgtatgattatagctatgataaagaacaagttgttaggaaaattgctacaggtgagaactatcgtattaattacataggaacagtaatttatgaagatgaataactaaaataacatacatcgcactgttttagttagggtctccggtagctagtggtgatgaagtaatgttaagaatctagcttatttgagaattgatattttcctgaattttaaacttgagttcaatctcgaattgtcaaatcaagtgtaacaccctcgagtcattcttaaatagtgggctgattaatatctgtagagccatccattgatggctgatgggcaagtgtttgccgtggccagtatttcaaagcatctttgatagtttgaattctagtgatagttaaggcttgtatgcacggactttccttatagaataaactccctgatttactatgacttatttatttggaggagcgtctggctaatgggtaaaatgaattagtcagtagaaataactggtatccgatgagaaataattgccgagtaccggttattttttaagaaaatattgaaggagtttcaagctaacccaaataattttggatttgagatacctatcagctaatagaaatcataaatatgaacaataaaaaggagaagaaaaaacaatgaaaatattaaatgtttttgatgcagtaagggatggcacgtttcaagactttaaaaatttttatgaaggaaatattaatgtgattagtggaaacttggatttgaatttattatgtatggcagttactaatgataaaaatccagaagaaaaacttcaaataataaagttcttatttgctgaaggaatagatgtgaattatgctacacaaaaagaaaaacgaaatgcacttcatttattttatttttgtgttttgcgacctactatagaatatgaaatggaaataacaaatcttttcattaaacatggaatgaatgtaaatgcgacagacaaatacaatgcaattccattgaaatatgctattacaataaataatttgccaacttcggacaataaagaaatgtatcagttgctgctgaataaaggatcagattacaatttgaaagatggatttggcaaatcatgtttagactatgcgaaggaatattcttggagaaatgattttttagatattgtaaaagagtatgaaaatagcaaaaattgattgaaggttgaaaaatggtaacgattataatgattggagtagtaatcataggaattacgctgggcttaggattctggagttatttactgggaaaaagaaatcaatctaattttgttggcactatcattccaatagcttactttgtcgttcggacagttttagctgtgacgacacaaaatatgacacgtgggctagtatcgtcattagtcggtagcttgttattcagtctggtttactatggtttatttgcttgggggaagcaccggactaataagtaatatggattagtcagataaaaataaaataaccgatattcgataaggattaattgccgagtatcggttattttatagaaaagtttagacaagttgagttatgagggtaggaacgacatatgttggtatttattgtgattggattgattacgggggtaatcacgattggcttgggctattggagttatgcattagggaaacgcaataagttgaatttagttggtagtgtcataccagttggtaatttggtgattaccgttgtttatgccctactgtttgttgggggacgacaacgattcaataagcaaaagcaaacaaaataggtcggctgaagatccagaatgttgatgaaattacgcgtgctggactttttagactattgcaggtattaataaaggcattatttcgtttttgacgaatctagttaggtataatgatatttataccatgattacggggaaagttgccgttaccggtaagaagtgtttatgcttagcaggtgtggcttggacatccctgaactctgtgcctgtctcaggaaagcaaagaagtgaggtagaatatatggatgttgatgagaattggtggcatgagagcgtactaaaagagttccataaaggtggtaagcctaatccagattttaatcctaaagctgctaagaatacccatatccctgtcggtaaatagagaaagagtagagaaatatgaatatagaagaaatcaattcagaaatattaaaggttaacaattatttaaaaaaatgtttatggatggattttgaatttgctagtgtggatggtggagatattgttgcagcaggtagaatagatacttcatatgatgagtttgctattaacattgatttcaggaaaccttattatctgtctagtttgctgtattggaacttaaataattctaagccatttatagagttggtagcaggcaaagaaatgtggaaagtcatcgataaataccaagtagaagaaggaaattatatatttaagattaatgctgaagattttgacacagcaccaataattattgctagtaaaggtcttaaagctgaaataataaataaagatccattttaaaaacaagaatccctgagttattaaatcaagtacaatactttcaactcgttcttaatcaggattttagctgattagcccattccagatggctttggataacttgaagaccagtgatggttcaggagcgcatcgattggtccttgggtatgagtttctggttcaactgtggcttttgttagtccagtgttccacgattagtatggtataccattgtgctaatcacttatgacaagtctgaaaattcttagctattatcaaaatttgcagcttttaaatgttctggaccatatccatgatttgctggataagacagtgatgggtatggcaatggaaagggtgatgttggacctcgtaaaggtattcaaaaatagtaaaaaatgacaatgattatcattatttgagcagtcatcataggaattacgctgggattaggattatggagttattggttgagaaaaaggacccaaactaatttagtagatgtcattattccagtagcttattttgccgttcgagcaatcttagctgtgatgacacaaactgcgacacatgggctagtatcgtcattagtcggtagcttgttattcagtttgatttactatggcttatttgtttgggggaagcaccgggccgataagtaatatgaattagtcagattaaaataaccgatattcgacaagggctaattgccgagtatcggttatttcatagaaaagttgagttatgagggaggcaacaacacatgttggtattttatcgtccggttagtctttgtgcgggtacttggtgacggcatttgagaactgataactagtttagttggtaatttggtgattaccgttatctatgtcctgttgtttgtttggagacgacaacgattcaataagcaaacaaaataagtcggttgaagatccagaatgttgatgaaattacgcgttctggactttttagacgattactggtatgaaaataagggcatcatttctaacggatctagttgggtattaatgatgtttatatgaggtcaagaaaatgagtggagataaaactccaaaaagtattgaagaagagttgacgcctgctcaaaagaaaagtgtaaataataatgttgctgatcatttaacggatggagattttagtggaactagaagagactcagaagaaaatcctgttccaaaaacagacgcacccggggaatactggaactacttagatgaaatgctaaatacgtacaaatctataaagaactcaaaaagaagaatttatgaaaatatataataaattcaaggaaaaagcatctgatctatagtttgttataacagagttattatctaaaatgtcaaattaactgattccgattctcgttagtgccatattctcttggtgagtaagagatgtgcaaaatagaccgttgcgcaggtcacttgggataagtccgcaagtttggacaggttgaaggaaaaaattaaatgtggatgatgattgtggtattgaaaaatgttggaacaaagtgactgaacttttgtctcttaatgaggatattacaataaagtatttagaagattgtgatgcggacggacttatattggatcagtgaagtttttgaggatatttctgccaatttgaaaagtcaaaagtttattgattgtttaaggaaattggataaaaagtttccaggattagaaatggcacatgacattgatattgctgaaagttatttttaaaggggtatgtaaacagcataggcggactataacattaatggaaaagtatatcgagtcgcatatggggacaacggtttcgtcgtatcgtttcatccaatgtgagaataagtaatacgagaggagaaaatatgagtaatttagaaatatcaaaaaattgggaagataataatttattagaactaagtattaatgcgaaatcaaaatttgtaacaatccatcaactgtgctatgtacaagatacagatttaaaagaaattggcgagaaaattattgcatattctttcgacgctaaagaagaaatttatgtggaatttggtgaaaaagaaggaaattttacaccagcattttctttaagctttttaccggccgataattctgggcgtgtaaaaatagagattgatatggagattgacgataatcctgatagaaagcatagatgtaaattttatatttatagtgagttaggattgattgagcaatttggtagaagccttattctgctatctgaaaataaaaatgaagatatcgcattgaatgttagaaattaaaggcgatttttataatcaaattagccactaatttttctactccgggttctcaaaacaagtgtaacacgtacgttaaatagtggatcagttaataaaataaccatctatgatacctgataagtaagtgtctaccatgcgtattggttcaaaacatcttgaatggattggatttcagtaataattaagaatcgcataaattatcttttggaaataaaatcgcgaatttaccggtttggatttacgcctaatccgtgtttccaaggtgagtatgggtaggggaaataggcctcgatggtttttggggggttagtcttttatgtattacactttaattttagattcggaaagttaagtgaggtaataatggaaaataaaatttcatttgtcgataaagttgagcttgtgtcgttgaaagaacgattgaatgatttaaattattttgttgttacagtaccaggcaaaaaagttcgcacgtttcgtcaatatctgaattttatgggtaaaaaatttaaaatgccagattatgcaggctttgctgcctattcagattggatgacagacttgagctggatacccaatcaaaaaattgcagtaataataaataaatatgattttttcatgaataaaaatcctaaattaaaaaggttaataatggacagctttgaggatgatattttacccttttgggaaaaggatgtcgttcaatttatggttggtggtaagccaaggatttttgaagtttatattgtaaaataatactttatttgagctacagctcagatagtgatcttaattacgggtagtcaggttgagcagacgttcgtatcataaaacaatcagtaatgatgggttactcgaatataatataaatagttaggtggtgtaatggctgttctaaacttaaggctatgttgttgaggatagcagttatcaaatgaatacccaactgtggcgttgccaacgatcaacgttgctaaggtgttggcaaaaaatgaacgagaattaattattttgatgcatattaaaaatcagtccgtcgtattctgccgtgataaaggcagagaatgcgatggactgattttttgaaaccactaatttaacaagctaggatcaatctggcggtctttaaagtagtactgacggtcgtgatcattaatgtgtcgcaagatatgggcgggattccccacggcgacgacgttatcaggtaagtctttggtcacgatgctaccagcgccgacgacgacattgtcgccaatcgtaataccgggtagtacgatggcacctgcgccgaaccaacagttacggccgatatgaactggcatattgtactgataagcttgttcgcgcaatgatggcaaaatcggatggcccgcggttgcaattatcacgttggggccgaacatcgtatagtcgccaacgtaaatatgggtatcatctaccagtgttaggttaaaattggcgtaaactcccttgccaaagtggacatggtgcccaccaaagttactgtgaaacggtggttcgatgtaacacttcgggccgatttctgcgaacatcttgctaagtagaatttggcgcttggttagttcgctgggccgagtttggttgaaatcatagagctgatcgagatagccaaattggcgtttttcaagttcagggtcgttaggtaagtagagttcgccagtatgaagacgatcgttattattggtcattaattaaacttcctttcgtggatgatggctgccggtaatcaaggctaagccacctaaaatgagcataatccaaatgagaacgttggcggtgagcgtctgtggcccaagttggccgagactgttccagaccagtggcgcaaagaaagcgctgataatggtggcaatcgtcaggtagctactcaggacgttgacttgaatggtatccaggccagtattgctagtgaagaccaaatatggcccggtgtacgagtaaataaagttgaaaaacacggcagcgccaatagccacagttgcattggatgccaaccataatactaagactgaaatagctgctccggcatagcctaaggttaaggtgaaccggtgtaaatagcggtatagatagccaaaggtgagaccagccagcaagccaccgatgttcatggctgctaaggttaagttgatagtggcagcgttaccaaaatgacgggcgctaaagtaactcggcagctttaattgaacgccccagatgagtagataggtgataaaggtaagtcctagtaacgtccactggtgccgtggtagttgtgtcttttcagtgcgtgcgtgattagtcgttgttgatggaacagtgggttccggtacgaaccacgccacgcccccagcaacaatcaccagtagcccgtatagccaaaagacggcgtgccaactgagactgatcagcaggcctgctaatcctagcaatatcgcgttacctagggctgagaggcccgtctggtaacctaacagtcgagcccgtaaatcaccggtaaagctgtgggtcaacaaactgatggcatgtggtgaaaagaggccgacgcctaatcctaatccgagccgactgaccatgattacggtaaagttagtcgtgatagcgggaatcagtcccatgatggcgctgatcaagagtccactaatcacgattggccgtaatccccaccggcttgttaatcgggggttgagtaacaaagtaatcaatgcgctacagttggcgatggtgacgagccattcaatcagcgtagtcgggacggtgggaaaggcccgcttgagctggggaatgattcctgtaataacggtagtgatgcctgttacagtggagaggctaagaatactgatggtggtggtcaaccgtggttgcatggcttacgcctccaaccagtttttgatccactgtaagacgccttgttcttggtttgtacctgtcgtggcgttggctacggctgccacggctggttgagcatttgccatggcaacgccgcagccgacctcccggagcatttctaggtcattgcccccatcgccaaatgcagccatgtctgcgaggtcgattccgagaacctgtccgagttgcgctaagccagccgccttattcatgccgggttggataatgtcgatgtcgccatgaccactgctggttggttcggcgatacccgtcagtaactcgcgtagttgcgtcacaatcgctgtggtgcgttctggtggacatgtgatggcgaacttcataatgtcatcatcaagctggtcgtaactttcaacgacggctaagtgatgataataatgtcgcatttgcgccacgtgctcaggattagtggtcgttagggtgtaggcacttttggcaccgcaaaccaatagctttaaatccgggatggtttgaatcttattcagaatcgtctggattgcgtctggctgaaaggcgttaagtgcgtaaacgtggtcggcatcgcggatataagccccattttcagcaaggtagatcatctcaggatagtccttgaagaaggacttgagttggaaatattgattgccgcttgcaatcacgaaccgtacgccccgtagttgtaattgttgataaagcagtgcaaattgagcttcgtcgtaagtcatgtcgtcacgcaaaaagctgccatccatatcagttgccattaatttaatcatggttaaaatctcccgtcgtttaattgatagccgtagcttaccacgaaattcagatcacgaagggacatttttagaggcaactagtatcaattcggtgataccgggcataggcttgacgatagtcagtaggcgtcatacccttccaagatttaaaattccgattgaacgtcttactattcggaaagccgcattgcatggcaatatattcaatcttatggtcggtctctaacaggaggcgacgggcgttcatcaatcggatcagtcgtaagtatcggttaacggatagttggacgtttgcattgaattgctgattcaaagtggtcaacgaaacgtgaaattgctcggcaagggtattaccatcgatgggctcagcgtaatgtcgattgatggcagtcatgaccgtatccgttaacgtcaagttagggctgaccgttgttgcagtcagaggaacggtaaacgtttgccccagagtgacaagtaactggtaaaagtggctgaggatttgtaatctcagtagatcggtcgtgggggtcgtcaacaggtcgtgaatcgtgactaattgttggcggacatcggcgtaggcttgtgggtgagttttcgatgaggccgcgccgttcaatgtcaattgccagttcgcacttgccggaatttgagtttgtaagaaatcgtcgtcaatgatgaggccgaactctacccagtcaacttcggtgggcccactagcgctgtgaaccacgcgtcgattagtagtccaaaggtcaccaggccgatattcattcgtctgtccatcggtgacgaattttaaggtcgtaccgctgacgagataatttaactcaatcccttggtgccagtgtggggcaacgttgatatcagtcaatggatcatgttcgtaatatttaaaggggaggcggggaattgtctggaccgtctcgtgtaagattttcatcactaaacctcgcttcaagattttgtaaaatcgcaccgcttcctttcaaaaatcaaccttgatggctgacgcgctatgctatattagaattatagttcgcgatgagcggtggcatgacttaattgtaaccgtattcgcagttgaaaggaacgaaaacccatgacaattaaattaattgcgattgatattgatgacacgcttctggattcaaaggggcaattattaccaagtacgattgcggcagttaaggaagcccgcgaccaagggattaaggtggttttgtgtaccggtcggccacttgctggggcgcaacattatttagatgcgttaggcattgctggtgatgaccagtacgtgattacgtataacggtgctgtaatcgagagcattgctggccggatcgtcgccaaacatttagtggataatgcgcactatcggcaattaaccgcgtttggaaaacaacatcacgtgccctttaacgtgctcgatgcggacagtacgatctatacagctgaccgcgatgttagctgggtcacagttgtacaggcgtgggaaaacaaagctgggctgttgattcgagaccctgacgatttaccagctgattttcaagttgccaagggggtctttgtaggtgaaggcccgcaactcgatgccgtagaagcgcaagttaagacgacttttggtcgggacctgtacgtggtacgtgcggcaactaacttcttggaactgatgcatactggtgtcaacaaggggcaggcagttcaggatttagcggcagctctggaaatacaaccggacgaagtgatggcactgggagacgaacagaatgatctgccaatgtttgctttcgccggaacagctgtcgcgatgggcaatggcagtgatattgctaaggcacacgctgatcacgtgacggctactaatgatgcgaacggggtcgcagctgcgattcggcagtgggcattatcggattaacttggatgattatttttagcgaaacagttgacaagactacgcaatgagtttatgattgcaaatattaaaaataaatgagactaaacgtgatgatcaggagagtaaagtcagggtaatcttaagcgagccgctggatggtgtgaagcggtggtgagcctggctggaaagtagcctgagaactgctaatgcgacgagctggagtgttagctgggtgcccccattaacgggccaacgtatcgtcagttaacattactgtttggggaaacccgtcatcagtgttggcaattggccgtacgcgcaaaggtgacgagctgcggttcgtgacgaattaaggtggtaccacgcgttagcgtccttacaaaatcattaattgattttgtaaggacgcttttttagtctcatggcagttttgagaggatggggacaatgcacttaacaagtagtgatggtggtttgtatcgagtgctcctactagtgattgttcaaactggttgatgagaacgacgcttaacggaggagagacgacgatgcaaataacgcgaaaattaacaatcaaacattacatcattattggatcaatgctctttgggatgttttttggggctggcaacttgattttcccaattcacttagggcagctagcgggggccaattggttgacagctggttggggattcttgctgacagggacactattgccactgttaggaattatcgccatcagtgtgacgcacagtagtgggatttatgagctagcgcggccaattggcaaacgctacgcgacgatttttatggtactgacttgtgcgactttgggccccttgttcgcgacgccgcggacagccactacgccgtttcaaattggtattgctagtcatgtgagttcggcacaggcaccgtggtatttattagcttactcattgattttcttcagtatcacttactgggcagctcgtaggcccacccggatcgtcgatacgatcggtaaattgttaaacccagcttttctgattttgctcgccttaatttttgggagagcgtaaaatatcttgtnnnnnnnnnncaagattcttgacgctaccaactatttataactatgttaaatttacagataaggagggggtattattatgactaaaaatagtatgtcttttgataaagtagtaggtaaaagtttaaatgttgagcagctgcaaaaggtaagtggtggacagtttaagaatatttcattaatgtatggaaataatgtttcccgcaaaacactgacaaacttttttaaatctttaataaaaaagataaattaggtggtgtcccgcatgctggattttggtgttgttgataccttttatcagggatttacctctattctagtagttttgttatggtactattttttatctggtttatttaactggaaaagcattttgaaaatactggttttagcatttcttttgggagtattaagtgtttttgttgcagattttattcttctaatcatggtattgattaattttgctagtcaatttattcaaaaaaatttgttggattatgataaaagtgggattttgctactagttgtaattatccaagttttaattggtaatattgcaatgtttctaggaagaatgagtgttagaggattgtataatgtctctaacctgatgggtgtacagtactacacacatgagctattaatagtatatgtaatattcgttattgctattaattatgttgttttatttttctatagacggtattctcataaaatagcgagtgttagtcagaagataaaggaattaaatttaagtaaatcgttatttgagctggttctaatattttatgttgctattgaaagtattatgttaataagcttaaatgaaaatattacggcgaccattcaattaactttaataacttcatttattgtgatgttgcttatgatgttgtggcagatggttttttttattcggtcatatatgaaaaagcaagaagctagccaccaggcgaaacaaaatacacaattaaatgaatatttgaagagtgttgaacaacaatatcttgagctaagaaggttcaagcacgattacaagaatattatgttgtcattgcaagactccatatctaacgggagttcttcagaacaactaccatactttaaagaattaattgcgcagagcgctatcgacacgtcgttagataatggtaagatagctaaaattcagtacattggtaatgaaacattacggggattaattgtacagaaatttttcgatgcccaaactaaagggattgagctgagtctcgaacttgatcagagtgaattcataattaagcataatttggtagatgttgttcggattgttggtaatttattggataatgcgattgatgcggccaagtctactccagataagcaggtaacttgtgcatttaactcgctacacgaaacgaaagaaatttcagtgagaaattcaactaataagaaacttgacgtgaataagatgttcgaattaggtgcatccactaaagggagtcagcgaggctttggcctatcaaatgtgcaacaattggtagacagacaaaagaattttttcctggatgttgacagcaaaaatgaccgagttattataactttgacaattttggaggaagaatgattgtttccaatttatttatacgaggataatgctgagcaaagagataattattgtaagaccgtcaataatacaattatgattaatgagtttgcaatggagcttagggttgcaacggatgatcaaaaaataattctagcagatttgaatcaacaacaagatggccttttctttttggatatggaaattggtgaggacaaacagactggacttgaattagccagtcgaattcgggcaacgataccattggctaaaatagttttcattacaacacacgatgagctatcgtttgtaactctggaacggcggattgcaccgttggattatattttgaaagaccagtctgctgacctaattacgcaaaggattattaaggacatcaatgtagtacagaacgaattaaaaaagactaatagtcagcgcaaagatgtttttaactataagttaggaacgcgatacttttcactcgcattagatgatgtgattttgttgagtacatctaaactgcgtccgggcagcgtacaactccatgctattaataaggttgctgagttcccaggaaatttaaatgcgctcgaagaaaagtatccgcaatttttccgatgcgataagagctcgttggtaaatttaaatcatttgcgaagttttgactataaagaaaaagagttgttgctcgacggtgaaattaggtgtaaggcttcgtttagaaagtcgcgggaattgaataagttgttgagagacaactagttttttaatattatttagagcttctgtcagtgttatttgacagggctcttttgttatgaatatgaaatctgattatataatataggcgctgaggtagcgtcaagaatcttgtnnnnnnnnnnacaagatattttacgctctcggcgctgaagatagttggagtagggctctgtgatcttatgagtattaaaatgactaaaaagtaagcacagtactcgatcgtaaagtatattagcatagcgttaagacgtgaaatttagttagcgatatgactagctcttagcgtaacccaaaacttcagagataattgaaattgtagtgctgcaaacaataatttataggaattcagaatggatgattactcgtctattttatcttaaatatttaggatactcaataacttccaatgcttagaggataggataaacgtagcaatgccaatgaataaaatatttagaaagagcccctttagaagagcttccattggcccgttaatgggtgattgagttgggtcaataccttgagaatagaaactagaaaaatctatcaaccaatggacactaatggcagccagtaagcttccggtttttaaatagattgctgcaagtaaaatacctaacccaataacatagagaacctgacacaatactgaccatacgggctgtgataaaaggttgaccaaatgcatagccgcaaaaataagcgaagcagtcatcatcgaagcgatggtggcctgcaatgtggcaaattttttaaggtttagtgctaaaagcgttctgaatatcatgccacgaaaagcgtattcttcagttatcgctacaatcaacgaaagtaataatgagattaaaaattgatacatgtggtttcgaaagaaaataagtagaaatattattgctaggctcaaaggcagactattcttctttaatattgacatgatattaacgggtagccagtggataggttgcttaacatatcgcctattcagaatgattatcgcgattaatataatagattcagttaatatgaattgaaagggtccgtcttttattcccataatatcagtcaaaggattcattaaaaagagcactattaggtagtaaatagctgtgattattacttttattaatggcatagttaaaattccccccatataaacttaaaaggctgagcactgcaggcccagtcataaatcgagtgctttcttatagtgcttaaacttgatggcttgaactatccgtggatgaatcctcggacagcgctaatgacccaatcggcaggcccaacagcacttttataattattccgaacgccacgcgcgctataggcatggaaaacgccacctgaaatagcatttaattcacggtcacgcaaaactagaaattttttcataattgttgatctcccccaagaaaattaacgaatacttttcaaaataccacgaatgcctgcaactgaaccaatttcatcaatgtcgaacacttttaccaaagttataaccaccccgattaaaaccaccagatattttggcaagctttttttgcggcaacctggaatattgtaacttctcaaactgtagcataaataatcccccttgtatgatgttatttggaacaaatttagtttaatttatttttttaccagattgttgaaaaaattataaaagtaaaaaaacgttctcttaacgtcaaataccaatgttagctagttgatgtttaaccgttaagcctgatgaggacatttatcataaaattatgtacgttaatagatagttggcatacgataacatttgttagcccataattaaatagataccgatatttaataattggtgaggggagtacaagtatgcattggagaaactatgttgcgcaagttgacgagatggactgtggggtcgcagctttagcaatgattttgaaaaattatggttcgacaacatcattggcctatctaagaaatattgctaaaacgagtttagaagggactacggcattaggattagtaaaaacggccgaaaagttaggttttgaaaccaaagcaattcaagcagatatgagtcttttcgatgtccaagatttaccattgccattcattgtgcatgttaccaaaaatggggatctacagcatttttatgttgttgtaaaaacctcgaaaacgcatgtcgtgattgctgatccggacccaacagttgcggttatcagtatgtcaaaggaacggtttgaaagcgaatggtccggagttgcccttttctttgcaccgaagtcggaatataagccagttaagcaagataagggctcactatggggatttattccaagcttattaaagcagcgccgactggttattaatattgtgcttgctgcagttttaatcacgattattagtatctgtgggtcttatttcttacaagcggtgattgatacttatattcccaataatatgcacagtacattggcagtggtggccattggtctaatcgttttttatacctttcaggctatctttacttatgcccagaattttttattggcggttttaggtcaacgactttcgattgaaattattttaggctatattcggcacgtctttgaattgccaatgagtttttttgccactcggcggacgggggaaattgtttcaaggtttacggatgccagtaagattattgatgcgttagctagcacaattgtttcgctgtttttagatgtcagcatcgttattattatgggggcaatcttggtaatccagaatatgacacttttttggattacgttactctcgttgccaatctacgcggttgtcatcttagcctttaataaatcctttgaacgattgaatcaaaaggaaatggaaagcaatgctattttgagttcagccattattgaggatcttcatgggattgaaactgttaaggcgctgaatggtgagacggaacgttatcagaaaattgattcagaatttgttgattatctacgtaagagtttagcctatcttaaagcggatactttgcaacaggcattaaaactgtttatacagttagtcttagaagttgttgttctatgggtgggcgccaatctcgtcattcataatcagttatcagttggggagctcatgacatataatgctttattagcctattttgttaatccactacagaatattattaatttgcagactaagcttcaaagcgctaaggtcgctaacaaccggttaaatgaagtgtatttggtcgctagtgaatttgaggcgtcacggccaattcataatgaaagtcaattaaatggtgatattaagttacaaggggtcagctatcgttatggttacggtgaaaatgtcttagatgatgttaatttgacgattcgacaacatgataaggttgcaattgtggggatgagtggctctggcaagtccacgttagttaaattgcttattgatttttatcaaccaaatagtggtgatgtcatattgaacggcttcaacgttaagaacatcgataagcatacattgcggacccatattaactacatcccgcaggaaccatacatcttttcagcgaccattgaagaaaatttaagattaggtaatcgcagcggtattactgagaaagatattgcgaaggcttgccaattggcgttaattgatacggatattaataaaatggtcatgcaataccaaactaagctagatgagaatggtaatacactatcaggtggtcagcgacaacgattaacgattgcgagagcgttattatcacccgctcaagtcttgatatttgatgagtcgacgagtggactggatgcaattactgaaaaacaattaatcgataatttagtggcaatgactgacaagacgattatttttattgcccaccggttgtcgattgcaaagcggacgaatcatatcatcgttctgcatgatggtcgggtcgctgaagaggggacccatgcggcattgttgaatgaacatggttactattacgacttgatcaatagctgagggggaaactgaataatgagaaaagacctgctcgaaagtggcgagttttacgggattcggtttcaaaatttttcaacattattaattattccagtgacgctattgttaatgggtacgattctgttttcactcgtagctaagcgcgagattgttattaatggtaccggaactgttcaaccgaccggaacggttccggtgattcaagcgactgttaatagtgccatcaaaaagaattatttagttgaaggtgcgcgagtgaagaagggccaaaatctattagtttatactaacgtttttaatcgcaataaattacgcgaagataatgtcagcaaacggcaattggaacgccaagtgacagccttggatcattttaaagatggcatcaatactgacagtgatgtttttccaacgaccgatgaatttgggtaccgagaactattgcaaagttatttaaaacagcgtcaaatctatttaacggagaatcaaatgttggcagcaaaatcgagcgctgctagtactaagaaagccacgctaacgaagaccgcgcaacaagtggtatcaaatactaagaccaatctggatgcttatcaagccttatacaatgcggtggctaatggtagcaagtatgccaatagtgccaagtatgggtctgtttttaatgagtatgtcgctaagtcaaaggaggccaacaacgcaaacgataaaaaagaagttaaatctgcaacgttagcagacattcaacagcagatagatacgcttcaggattcgttgtcctcagctaaagtgcagttagaagaattacaaggctttgatgatacgaagtacagtgttgagactaacaataccaaattagccatgttaaagaatgatcagttaagcgaagtcgctgagaaacgaatgaaagccgagcaagatttacggaccgtgaaagcagatattgatagcttaacgacacaatcaaaattttacacgatcaaggcaaccaaaaccggcgtcctacacgttgcagacaattaccgtggtgcaaagtacgttagttcaggagctgaaatcgctaaaattttaccgataatcaagcaacaacggcgagtgaacgttaagctatatatttcgacggcggatatttcttccgttaaagtcaagcaagccattagattcaaagtcacgcggaacgtaccgaagccaattattttggacggtgtggtcacaaagattggggtctcaccagtcgaggagagtaaagcgactttttatgaagtgacagcggccgttccgattacagccgatcaggcacagttactgcgctacgggatgattgggcaaacggcgattattacgggcaaggtgacttggtttgattattataaagataaggtgctggataataattgatggtggtccatcagtactaactgactaaatatcactgtggtaaagtaaagttatctagaagcacatatatcatacgaaagaggtaagtaatggcacactcaaataaacaattcatcattaacctagtcattgccagtctaatcagcttagcattggtgagctttagtatggcaccggcgtatcttttcctaattaagaataattggttcatgatcacgattggttttgtaatctatgccttggaagcttgggggctatattggctttattggcatacagcacgaattaggcattaccaagtcgcgacgttgaagtcccgggtgaacattgcacaattaggaactgtgattattgcgatgctgacaatggtcgtgctcattattgttgatcttaaattgagcgcgatgctaaatattcccgagaccagcaattccaggtcgttggcatggatgctcggtgaagcaccgcttcccatgattgtttcggtcgtgatattttcccccatctgtgaggaattgatttttcgcggtatctttttcagctacgcgttaacgaatcagtataatcaccgtaattatcagatgatcgcggttgttattaatagcttaatatttgcaagtgtccatgttgatgcaaattgggagccgtggatttattatacgttaatggggggcatcttggggacaacttatttgttggctaagcgcgatattagaatgaatattctggtgcacatggggactaatttggcagttttcgcgttggcggctatgagttaatgttgtggataaaaaattaaaacataagaattggtttatccacaggggataacttgggaggcttggtatggttgctcgattgatcagggtatttggttatgtgttagcgggtttagggctatttatattcattcaattaccggtgttagcggatggctattggaattggtggggtgaacgcccgcaacaaatcaacgtcggttatcattggggagcattagtcgttttaaccgttggtgttgcggtcgtactagtacgttgctatcaccattattttgagatgccagtcctgttagggtatttttcttggtcaatgatggggctgactgctttagtggcagtggtggtcgtggtgattcaaatggggataagtggtctgctagtcagtccaaccgaaacacaaaatgatgaaatcatggcactgatccacagtccattggggttattaacattagtgtgcacaaacatcgttagccccgtactcgaagaattacttttccgtggaattgttcaaaatacgctgcgacgatacttgccagtattgggcgcgattatgctgacaaacgcagtattcgcactcggccatggttatcagttagccagtacggtgggcatcttcattacaggatgcggtttttcatggttagtactcaaaacaaaacaactgagtaccgcaatgggatgtcatatactggtgaactggctggtcacacttattaacatgatgtggggataagtttcagttagtgatatccggtcaaaccgcaagttgtggattagttaccattggggataattatcaggaaatggatgtgaaggagcatggtacatcaaaacgtcaaatttattggtagattactacttgccagtttattggcagcaatcgtgatggggcttagtacggcgcccatcgatattttaacactcaagtataactggataacggtggcgatcttcttggtcgtctacctgtttgcaatttatttattctatcgaatttatctggaatcagttactaataatcattttaagattacgaaaatagttgctaagccgagcgcgcgtcaattagtgattacggtactggcaatggtggtcatgctgattttggcagcggtgcaagttaaatttgttagtgatgctgtctatccaatcgcggagaatgttgctgacttgcaagcattgtctcagcgctcaccgatattgatggcgttggccctgggtgtttttgcaccgatttgcgaggaattaattattcgcggcaatttcttcagttatgcgctggcggaacgttttgatcagccacgctaccaactagttaccgttattgttaacggcgtgttgtttggtctactgcgtggcggttttagttgggtgcagttgtcatactatacggttatgggtctcgtactcgcggcaacctacatattatctggccgggatattcgagttaacagtgtcgtgcacgtcacagctaatctgggcctcatgctaatggcatgaggccagatggacttggcaagtaacttgagtgggttgatttaaaagcccgttagtgaacattctagttacggttgtttggatggagtggatgaaatgttacagaagaatttacggtttattggtaatttactaattgtgagtgtgttgagtgtcattattgtcaatatcagttccttacccgtgtatatttatttgattacggccaattggtttacactgttagttagcttcagtttatatgccgtgattatcgttttcttgtacaacatctataagacgaccgcggaattacggcaatttgattttcgaccgtggcgaacgcggctaaataaacgggccttgctattcatgatgatcggcgcagtcattatcgtggcgcttgcttttggctatgctaagctgacggcggtatggcacatcactgaatcgggtaatgaacgttcattggatttactgttgcggaaaaatccggtagcgatgacactcgatgccgtcatttttggaccaatcgctgaggagctgagtttcaggggctttttctttagttacgtcttgtcagaccaatatcttgaccgggagtaccaagcagctaccattgttatcaatgggcttcttttcggttatctgcatagcggaaatagcttggtgccattagcatattacacgctgttcggcatggtgctggggaccatctacctattatctaagcatgatattcgtgtgaatagcgtgacacatatgttagcaaatctggggatactctggttggttcctagctaaaataggggtcgtactagtcgggtactcagatgaattggatatttgggtgtggtcagctaataataggagcaagagtcggatggattgagatatacacgtgatacgggtataatcgattaagaattttgcagataaggaaactcacaaggtttaccaacaaaaattctctaaacaattgccaccaaccattcagcgattagcattgcgaaaattactaatgattgatcatgcggaaacaattaatgatttgagcctaccgcctgccaatcacttggaaaaattaagtcatgatcgccaagggcaatatagcatcaggattaataatcagtatcggatatgttttgcaattcgaaatggtaatgagtttagttttatgatgttgaaatagtcgattatcatcatggttaggagaccaaaaaatgaatgaaatcccaacacctaaaattagtgaaattcttgaagaagagtttatggctcccttgcatatctctgcatattttttggctcaacagattggggtacccacgtcacggattcaagacttactacatgatcgtcgacaggtgacggttgatacatcgctgcggctaggacgattctttggagtgtcggatcgttatttcttggaacttcaaaatgatattgaaattcgtaatttgaaacagatacatggtgctgaatatgcacagataaaaaagtatcaagtcagttaaataaggacgtagaccgtagttgcttggtagcgtactacggtttttgcaaatataacctaaactgataagcagcagatcttaaattttaaggttatcaacaggtggataaagcagtggcgtttgtattatccacctgttgataatcattgagttggctaattgcactttcactactgggttaactggtcgtgagaaaaatggtcaagcattagtttcgtgataacgaaaaacgactggaagtagctagcgtaataccgctgggctacttccagtcgtttttttattacagttatactcgtacctgatgttcaatcgtaaataatgtcgggtccaattgggcaattagtggggagacatcaccgatgctgagcaatgtcaagtggtgcatcgctcgtgacgcaatcgtgtataagatgccaactgaatccgcatcgggataattggtagcggagacatcgtatgcgaccaccgcgtcaaattctaacccctttgcaaggtagattggcataacaatcacgccttgtggcatggtacggtcgctatcggccatcaacgttgttactgtatagcgcttcaggtattggtagacctgcttgctttctgctaaatctttagttagtacggcaacggtgttagttgccttgagctgatgttcaacttcgctacgcagactgctgagagcggcgtcttcgccatagcgaatcatgaccttaggtaaatcgcctttacgtgtgaacgcttgaatctggtcgccgtcgggtaatagcgctttagcaaagttcgtaatctgttcggtcgaacggtagctcttattcaacgtaatcaagttcgcccgtcggacattgaaagcatccttgaggcgttccagtaattgctgtggtaactcaatccccttgaataatgcttgttcactgtcacctaacagtgtgaacttagctagtgggaacgcgtgcttgatatataacagttgtgctagcgaatagtcttgcatctcatcgacaaagatatattgcatccgccggttctgaccactgccagttaggacatcgcgtaataacaatagtggcgcgcagtcaaccagagcaatccgatggtactcaacggcggcctggtaagcggcaattcgttgttgccattggtcaggcgtcacggtggtgggccgatcaacttgcgctaagaaatcgttatattgttcataggtgtctaagaagtaaccattatagatcgcatcgtagacttgctgcagtcgtttggtcacgatttgcttaccaatatagaagacttcatcgtcgagtgattgaaaatcaccgcggcgcttggaacctaataagtcgtggtaagcttcgtcgctcaattggtcaatgatatcattgacccagtcagcttgggcttcatcgtcaatgcgatgctttaagcgtttaattaaagtgttcttgattgctaggaaacggtcagctggttgcatcgctgctggtaaggccgtcgcaatctttgtaatgacctctttagcgaagaagatttcgccattaaagacgatgttggtgaagcgtaattggtcggctggtagctgatggcaatattgatcgacttggcgcataaagtcggcgctttcttgaaaatcgcgaattgccggtgtcagttgttcacgctggcggtcactttcgtagcgctcaaagaggctttcaacggttaggccttgaaaacgtgcactgagaaattcggcaagcgtgacttgacgcatattgcgctcccctaaactaggtaagacttcggagatgtagtgactgaataagcggttgggcgagaataataccatttggtccgcttctagggaagcccgtgagtggtagagcagaaaagcgatccgttgtaaaatggcggacgtctttccagagccggcaaccccttggacaactagtaagtcactagtggtgtcacgaataatatcgttctgttctttttgaatggttgctacaatattttgcatgtaggcatcattttgttctccaaggacggcctgcaagatttcgtcaccgaccgtttcattcgtgtcgaacatattcttgatctgaccatgattaatctggaattggcgtttcttgatcagctcggtcgtctgctgcccggccggtgtttggtactggacctgacccagagtaccattgtagtagactgaggaaatcggggcgcgccagtcgtaaactaagaaattctgttcagcgtcgacaaatgaggcggtgccaatgtataaacgttcggcttcctcgtcgggactatcttgaatatcaatgcgcccaaaatagggtgagttactgagatctttcaagacaccgacttgccgtttcaagatggcttcggattccacggcgcgttcaaccatttgcttttgttgttgcagttccgcgttcgtttcaatccggtcatcgacttcaaacgtgttgacggaattattatcaccatagtttttctgaatgacatcggtttcgtgatgagcctttgccagcaagtcgtcggtctgttgtgcccgttctttaacttgctcgatgactcgatcaacccgttgttgttcgcgttgttgctcttgatctgatgttgccacgtagagggcctcccgtctgataatcgtctaaatcgcttgaacaattttaggcgggtttagggatgatgtcaatcaaagcgcctgcaaattcactgatttatcagtaattgttgtgaaatgtgattatgagtggcactaaggcgtgctagccaacggtgggcaagttcggcagccttacgatggcaaggctgaaacttgcaacctatgactatttattctaatatgattttaatcattctaataaagtgggtggaacgaatgcgtgtcgcactagcacaacttaatattcagtttggagatccggatgccaactacgagcagattgaagtggccattcaacgggcagctgagcaaactgtcgacgtgatcgtcttaccggagatgtggaataccggttatgcgttaactcgcctgaatgtcttggcggatgatgatgggcagcgaacgttacaattactcagcaagttagctcggcagtttcgcgtcaacattgtcggtggctcagtcgcggtcgctcgcgatgggcattactataatgagatgttagtcgtcgatcgtcagggacagttactgagtcgttacgataaagtccaccggtttgggttaatggcggaagaccgttatattaccgctggtgagaccgagaacgtttttgaactcgacggaactgttgcgatgggggcgatttgttatgacattcgtttcccagaatggcttcgtaaacaagcagcccgtggcccccaagtgatttttgtcagtgctgagtggccgacagtgcggcagatgcaatggcggctattactgcaagcacgtgcgattgaaaatcaagcattcgtggttgcggttaaccgcgttggcagtgatcctgataatcaatttggtggtcagtcactagttattgacccgctcggccaaattgtggctatcggtggtgcccatgcccagttgattacggccgagcttgatttaacacaagttgaccaggttcgtggtcagattctagtgtttgaagaccggcgcccggaattatactgaagcgtaaattggggactggggctgggagcacttaactgaattttaatggtgttgaaggaacgcccgcttgaatttcgatgggcttaaacgtcgaaatgacggtcggtatgatgaaatggtagcggctagttaacgcgaatgatgcccagaatttattttgacacggtcaggtataaccagtacactagaactaattaatcgttgaagaaaagaacagtaaggcgtccaataacagagacctagcacgtgctgaaagctggggcggactaatgaattggctttttggagattcggtgaacaccggggacccacccttatcggtcaatgagtggcagagacaagctttctgcaatttaggtggtaccacggtgatgcgtcctaattaactagtattagttgatcaggcgcttttttagtgccaatagaaaggatgagtacaatgacaaaaaaagtgattttaacgggtgatcgccccactggtaagctgcatatcgggcactatgtcggttcattacgtaaccgggtcgcattacaagattctggggactatgattcatacattatgattgcggataaccaggcgttgacggataatgcgcatgatcccgaaaagattcgtaaaagtttattacaagttgcgatggactacttggcagtgggaatcgatccccaaaagtcaacgatcttagtccagtctcaaattccagcattaactgacatgatgaatcaatacttgaacttagtgacggtagcgcgcttgaatcgtaacccaaccgtgaagacggaaatcaagcaaaaagcttttggtgaaagtgttcctgccggtttctttgtttatccagtcagtcaggccgctgatattacggctttcaaggcgacgaccgttcccgttggtgacgatcaagaaccaatgctcgaacagacccgtgaaatcgtacggagcttcaataagacttaccaaactgatacgttggtcgaacctgaaggctacttcccaccaaagggcttgggccgaatccctggacttgacggcaatgccaaaatgagtaaatcactaggaaatgcaatttacctttctgacgatgctgatactttgaagaagaaagtcatgtccatgtataccgatcctgatcatattcatatggaagatccgggtaaggtcgaaggtaacgtggtcttcacgtatcttgatatttttgatgaagacaaggccaaggtcgcagacttgaaggccgcctaccaacatggtggcttgggtgacgttaagattaaacgctacttgatggacgtgttggacggtgtattgcggccaatccgcgaacggcgtgcaatttacgaagctgatccagctcaagtcttacaaattttgaaggatggtacagcgaaagcgaacgtggtcgctgaccaaacgtggcgtgaaatgcaagacgccattggaattaattattttaaataaattatggtagaaaatagtgcaactgaccgtcggatgtgtgaagacggtgagttgcacttttttgtagacccttaatatatgggactttccggtaaattaataacgatggcccaacgcatcacggttgcgaattaaaaagaaaaggcagactaaattgaaaattaggctgatttcgtttgctttcttacatgaatgattgtaaaaaagtgcttgttaaaataagtttttggcaagaaaaggggtggtaaggaattcgaaagcgcttgctgtggctgcctttagtcataatataaattcattggtataaaattacgaaaaataaagcgttttcatgtattctgtgataatataatttgtgggcacaagttttacaagcgcctactaatttatcgaaaggaggtttagtcatgtatcaggcaattgcgcaggcaatcattaaatcgataatggcggatgaatatccgactaagttaccaaccgaaaaagtgttaatggcgcagtacaacgccagtcgcaatacgattcgtaaagcgattgatgtggtcttccggcatgggttgttacgtcgcgtgcaggggagcggcaattttattatcaaacaaccgcagaacacgaagaaagtgctcaacttatcgattggatttgaccagtccgccatggttgagggtggaccattagtatcaaaagttgtcacgtttgataaagtgacagcggatgaaactttagcacaacaggggaacattgcgcttggtgacgaggtttatcgggtggtgcgattacgttatttgaatgacatcttgtatgacctggaagagtcttattttccgcgaacggtcgtcccgttcttatcgagtgagagcgtgcagcattcaatcttcgccttcttgcgagaggcatatggtattacggggagcaccacggaaaactacgtccatcaagtgcgggtggacgcgcaacgggcggagttgatcggttgcccagatggtgacaaaacgttgtgcttggaagcaatcaattacttggctaatgggacggtctttaacttctccaggacgttcttcgtctatccagatttggaactctattaccataccgaaaatattgatttacaaaactagtacgggggtgacgcaacagttgtgttgggtcactaactagcgaaaacctacattaggagtgaggggtatattatgaattcatttatcgaatggcttaacaaacacttagtgccagttgcggccaagattggtgcagttcggtggttgatcgcattacgtgacgcgtttatagcaattatgccggcaatgatggccgggtcgatcgccacggttctgaacgctttagttcgagatattccaacgaagttcggttggatgggcattgttaattcgatgcagtggttgattggaattaatgcgatggtttggacggggacgttagccatcttaggtctgattttctcatttacatttgggtatcaattggcaatccagtacaaagttgaaccagttactggtgggatcgtgacacttggaactttcatcatgagtttgccacaaaactttaccggcacgttgacgagtacgttgagcaagggcgctactaagattttgacggactctggcatggcggttgctggcaaaaaagtgacggcttggggttacttcaacttcaacacgtactttggttcgtatggtttctttacggtcatgattttaggggccattgcaagtgccgtttacattgctttgatgaagaaacacattacaatcaagatgccagattctgtgccaccggcagttgcaaacgccttcactggggttatcccagccgccgctgcattttatgtcgttgggattattaactggatcttcagtaaattcaacaccacggtgattgaatggatcgcgaagattattcaagaaccactattgaatatgagtcaagggtacggcgccgtcctcttaatgacgctgttagttcaagttttctggttcttcgggattcatggttccaatgtcctggcaccaatcttggacggaatctggttgacggctcagcttgctaatgttaacgcttaccaagctggcaaagccttgccatacgtttggacgcggaactgttttgacttgtatgcatggattggtggggccggctcgaccttactattattagtagcgattttagtgtttagtaaacgagacgaccaacgttcagtggctaagttggcgattggccccggattctttaatattaacgaacccgtgatgttcgggatgccaattgtacttgacccaatctactttattccgttcgttttagcaccagttgtgactgtttcgatcgcctacgctgctttatcagctgggtgggtcgcaccgattacgaacaatatcgtttggtcaatgccaccgattatgaacgccttagttgccacaatggactggcggtcagtggtcttacaattatttaatgccgccgttgcctttgcgatttacgtgccattcgttaaggctgccaacaagattaaaccagcagcgattggagaatagattgtcatgaaaagcttaaagcagtgtttactcatcgggatgaaccttggattattagccgttatcttaagtcccctggccggaacgaccggtcaatgggtgacgctcggattaggtttagcggtcagcgcagcacttttcgtcgtttatcggcgagtgggtcagatagaaaggagccaccagaatgcagattaaattaactttgaacgcccctgtggattatttataccaacagttgatcgattccgcgcaggctgatattcagcagcaaacgggtcggccggcgccacggcagagcttacaaggctatgagtatgccaaacagtggtccaacggtctgaccggtaatttgaagattacccacgcgcaacccggtgttcgatatgcgtatgaattagaaacgccccacgatcattacggcgtcgattatcaattcgtaccggacactgatggtcaccaaactgtcttagaatatgccgaaacctttttaggcaaggataagaagacgaatgccaataataagcttggcgtgctattcctaggatggttccgtaaacgccgctttaagaagatgatgaatcagatggctgctagttataatcaataagtaagttgctgaactgaaaaaaaggatttcgttatttcgaaatccttttttgtgtccaggcaagatatggaagctaatcagttgcaacgagcgtaacttcgtgtatactcaagatacacgggagggatgcgtaatgaaagcacgggtggttggtaattcaacgacattgacaattcctaaaaagttcaatgttgcgaatggcacagagtttgaagcagagcagctagatgatggttcgattttattcaaattgaaacatcgcaatccgttcgagggtgattggtttaatgaccaactagagcagtctgacataaccctggacatggaggacgtcgatagtgaatgggactaatcagtatattccacgtaagggtgacatcgttttaatcaattttaatccgagtgctgggcgcgaaatccaaaagtatcgcccagcattagttgttagtaatcaaaagtatgcgcgattaacaaagctagcgctagtttgtcccattacccatactgccaataaccggatgacggctttggggttgttgatcaaaatcaaaacaccgaaagtcgacggctatatcaatccactccaatttcacacgtttgattacgtccgtcgggatatgcgtcaggttggcgctgtcgataagcaaatattagatcagacactacaagttattaacgatgttgttaatgctaatgaagtatagcatgttgcttaaaatagcgcttagtcacagtgttcaccaatagtgtgactaggcgtgatgttcgcgacgccaaccaatcgtggcaaagttcgcgtttatcggttggttaagcgatgcttgggagcggacgaacggccagcaaacgtcattcctgcaaagcaggcatatcaatgctaaaattaaaagcattcaatccaaaagttaaactagtgataagggagtatgagaacgtgacagcaacaccattctggtcgcaaattgcggcccaagccaaggcagacgggcgaccattttttacgatggccccgatggaagccgttagtaatactgtttttcggcaagtcattagccatgccgctgctccagatacgttttttagtgaattcgtctatgctaagagtattacgaacccgaatacgaagtttccggtgcatggtcggttgtacgtggcggcagctgagtcgcaaaaaccggtcgttcaactgtggggtaacgaagcggctgactttgcttcggctacagctgaacttcgtgaccggggctttgaagcagttgatatcaatatgggctgcccggatgggacggtcatcaaaaatcatggtggcagcgatttgattcgcaatccgcagtgggctgaagacgtgattgcggctgcaaagacgtcgggactggccgttagtgcgaagacgcgcttaggttacagtaaagttgctgaatatcatgactggattgcaacgttgttatcgcaacatgtggcagtcttgaccgttcacttgcggaccaaacaggaaatgagtaaggtacccgcacactttgaagttatcgatgacttgattaaaatgcgtgatgcgatcgccccggaaacgttactccagattaatggtgacgtggctgattatcaggccggggtggcgttagccaaagcacatcctggattagatggtatcatgattggtcggggagtgttcgcgaatccgtttgcatttgagtcccatccccaatcgcatgatttgcatgaactattaggtttactgaacatgcagctcgacttgttcgatgactttgccacccgttatgacgtgccacgttttccgtccttaaaacggttctttaaaatctatgcgcgcccagaactaggcgccactgacctgcgtaacacgatgatggatgccaagtcaacggatgatgtacgcaaaattttagcggcttatcaagccaaaatgcaggtgaccaatcacagttagtgtcagcagcagacaggttgattaaggcagtaatacgttaataaacttcaatcttattatatagaaacatctcgatatcggcagtgagtgctaatgttgggatgtttttgtatctaaaggggtatgacaattgtattcaaatcattggaggactgattgttcgcctgtcgccaagctaatctggatgcttgtaacatcatttacaatgattgtaacgttgtcatcttatcaagaaaaccatgttacaagccttcgttactgccaactagctagtctaatgaacccaaaatgaacggccctagtcaaaacactagcgtcgttcattttgggctttttgatattttttggtgtgcaatccggccctagaagtcacagtgttacatcataaatgttagaataaacctaactaatattttataaacgaaaagtgagcgtggtgttatgagaaacttagcgattgtggatttagggtccaattcggcgcggatggcggtcagtcggttgcacgctaacggcactgctcaagaaatcaagcgtgttaaggaagatacgcgtttgtcggaaggaatgggaacggcacacgtactccagcccgccgcaattgagcgaacaatcaaggcgttactcaattttcgccgactttatgaaaaaatgcccaatacggatgttattggcatcaccacagctgcagttcggatggcacaaaatcaggctgaatttctcaatcaagtcaagcaagaagtggggctcgatttacgggtcttatctggtgacgatgaggcctattacgattatcttggggttgccaattcattggtcatccatgattgcctaatcttagacacgggtggcgcaagttgtgaactgatcttggtcaaaaatggccgcaaacagcaactgatcagcattccatttggcgcggtgacattatcggaacaattcggtctcgacgacttagtgccgtctgcgagtctatttcgggcgcagatgttcctacgtaaccgactggcagatatttggtggttatcagaagcagtgcacttcccaatcattctattgggtggtgccaaccgaaccttagcccgcattaatcggcgccggcaacaaaagttaaaagttgaagatattcacgggtatcgtctgaagacagagacggtgttccacacgtttttggacttactgtcacggtcgaaaaaaggtcgccaggaaatttcaggaatggaatatgatcgtgcggacattattgttggtggaatgttaccgctagtgacgttattacagatgttggatagtgatcgggtgatcttttctgaaagtggtgttcgtgagggaattatttcagaacacctcaatcaataggtcggttcggtagatgagtcgaatggagagaataggaatgagaatatgacagctgattttcggcacttttatcaaaaaaattgggcggaacgtactgccatcgtagcgcaacaggcccatttaacgccagctgaacaggcgttatttaaacaatattatttaccacaacatcatgaaattattgagaattatttgacggattacccattaccgatggggttggctgtcaacttagtcgtcgatggcgtggatcacattgttccaatggttactgaggaaccttctgttattgcggcagcaagtaatggcgctaaaattgtcaagcgtgcagggggcttcacgaccgtccttaatcaacgtgaaatgattggtcaaatcgttctggagcagttgtctgatccggctgcaaccgctgccgtgattgaagcccacgctgcagcattattaaaagtagctgatgcggcccatcccagtttaaaaaaacgaggtggtggcgctcggcgcctacgtacgcgtgttctcggacaaggctatttatcaattgacctattcgttgatgtgcaggctgctatgggggccaatatgctcaatagtatgttggaagccgtggcaaagtccatcggtgtgatgacgaagcaggacgctttaatgagtattctatcgaattatgcaacggcgagcttagtcaaggccatttgtgacattccggtcggattattacaggctgggcggtatgccggcaaactagttgcccagaagattgcgtcggccagcacggtcgctcagcttgatccgtaccgggccacgactcataataaaggtatcatgaacggtattgatgctgtcgctattgctagtggcaacgactggcgcgctttggagagtggggcacacgcctatgctgttaaggacggtcaatatcgtggcatgagtacctggaccagtgatggtcggatgctgcacggtgaactggaattgccactaccggttggcattgtgggcggttcaatcaaaattaacgagttagcccagttgaatcaacgaatattaggtattcaaacagcgggtgatttggaaagaattatggttgccatcgggttagcccaaaatctagccgctttacgcgccttggtcacgactggtatccagcagggccatatgcacctacagttgaaatcgctcgcgatggcagcgggagcgactcctgaggaactccccgttatcttacaacgacttgaattagcatctcaacaagacctcgcaaccacgcaacaactcattgcggaattgcggcaaacaaaggaagagactgatgactgaaattaaattgaaccaaactgttacagatttattaagtaccgccaattcgttatatccgggcaatattagtgttcgttttggtgacacaaaagcgggttacgtccgccatgatcaagcacaacaagtgttagatgatggtgacctgaccgttcgggttagcgatattacggctcctaattacacagcgtcacatgaattattacatctattattgttattacaaggctttccacagattacctttaatttaaccacgcgtgatcaacaactggacgaacaattgatggcaatcgctatggaactttatgacatggtgagccacgtcttggtcgtacgcaaacaacgtgaacataacttaatcgatgagcaaattgaaacgctatacatgcaaggtgtggcggccacaatcgaaccggaacctgcgggcaaggcggatgcgatgatgacgttacggttattaacattgactgacctactcgttttctttaatggtgaattaccagctgatgatttgcaaaaggtgacaacggcctatccacaagcttggccggctgcacagaagctatacgccgtaatcagtcagaagccagttgacaccccgtttgcgatgcggtgtgccgtagtaaagctgtttaaggcttttgatgatcagatgacggcttggcatttaccagtcctacacggaacggaatttgtgaccgttcagagtgtgctcagtgaacggcaagagcggctggaagtccggcagttatttgacgtttaccattcagatctattagataaaaataaacatacccgagcgtacattgggttatataagagtgaccgtcagaatgcgtttgtcctaccagcaccggcgcaaaagaagagcgatgcctttttcaaagaggtgtacgataagacggtcaaagaattattccaagaaatgaatctaccctatacgttacggtaagctaagcagggagatgtcagaatgagtgacattacagcagcacaaacaactttacaacaagctcagcatatcgtttttatgacgggggccggcgtttcgacgccctcgggaattcctgattaccggtctaaaaatggactgtataccgaacaccataacgcggagtattatttaagccacgcgtttttggcggagcatccgctggaattttatcaatatttacaatcaaatttatattatccagacgcccaaccgaatgtgattcatcaaaagatggcggcactgactcagcaagggcgggccagtgtgattacacaaaatattgataatttatatggggtggctaaaacggctcagctcgttgaatttcacggtaatctctatcaggtctactgcaccaagtgtggtcagcatgtcgattggcatgagtatttgaagtctccttaccatcagacagaccatggctacttacggcctaacgtggtgttgtacgacgaggggattgcgagtgccaatatcgaacgggcagttcaatatttacagcaggctgacctagtcgttatttgtgggacctcgtttcgggtgtacccgttcgccggcctaattgactatcgtaatccgaaggctcaagtgcttgcaatcaatgcggaaccgctccagttgccatttgcatttacgatggtgcaacaagatgcggtcgacttcttcgagggggtgcaggtctgatgataacaattggcttaacaacttggacggaacaccctagtttactgggtggtactgaaaagctgaccttaactgaatattcgggagtcctaccagtcgtcgaagtggacacgccattctatggtattccgaaagtgacgacggtcgcgaagtggcaaaaggccgtccctgataagtttcagtttattttgaaagcaaatcaggtgatgacgctgcatgacacttatgacgaaggggtttcgatggatgcgctaaagacagcttatcgggaataccgtgcgatgctcaaaccgttaacgcagcaccagcaattaaaagcggtgctcttccaatttccgccgttttttgaacggtcgaaccgcaacttccattacctacaacggatggtcgagtggttacccggtgttccaatcgcagtcgaatttcgtaaccagagttggtacgaggagagtgtcaaagatgcggtctttagttttctgaaggatctggggattacccatgtgattgtcgatgagccgcacgctttaaatgatggcgttagtttcgagccggtcgtaacgaattcgaaattggcactcttacgcttacatggtcgtaaccagcagggctggtcagccaagggcgctaactggcgtagccaacggactttatatcggtatagtgatcaagaactagctgaattcaagcaaacggtggaacagttacaacagcaggcggacgaggtttgcgtcatctttaataataattctggtggtgacgcggccgataacgcgatggcactcaaagagttgctaggcgtttcgtttggtgatttaggaccgcatcaactggacttgttttaaaatgatttatgagtgattgatgtgatactttgcttaattgaacgagttatcagttgaattactatgttggatcaatacagtcactatgaccgtgaaccgttgaaatttggtagtacggttgaatattctttaattgatgaatcatgacaactaaaaatgtagcggtagttgggacattcaataatgtgagctgccgctacatttttttgcacttacaccttagttaatcaatatggccttagccatctgatttgaaagcgaacggttgggatacatcatttggaagtaaagttagtgtaaagtcaagaagtagtttatgtaaattcctgtttagttttggtaataattatctcgttggtcgtggatacgatggcttgggactgccttaaaactaggcagttataagtaccttaattcatgattcttaggtgaattagggtgattgagaaaagtgcgtgattaagatacactgacttcagttcaagcaactaagtagttgcctgccattatgtgagttgcagatagttatggcaggttgaagtgttgttgagaatcgaatgttaggtcataacaatatagattggggcggattgggtatgcaaccggatattatttgcgcaaatggggttttctgcgctgatggaaaagtcttattaacacgggaatcaaaaaacacagcttattattttcctggtggcaaggtcggtgtgggagagacgctaacacagactctgcagcgagaattaaaagaagagttgtcattagttgtgtcgccagatcggtttaagtgggccttcacccaccgtggtacggcctataatcaaccgggaaaaatagtcgagttaaattgttttttagttgcggggagtggcgcgctcaaagtcgactcggaagtttatgattataagtggtgtcggccggacgatagccggatcgcggaagtcgttcgtgaagcgctggcccgatattcgtgggttgttgaataataatagattaccaataaatgaccggttaaaatcaactcgtgattttaatcggttattttgtggtggttggttgggccatttgaagcatggtagttgactagtctgccacgatctttgcgtgtggagaactcttttgttagtgtttcttaataaacacaggaaatatgatacaatataagagattctacacattggcccagcaacatgttattttagaccaagacgtgttgtttggacgcgtgtgatttgttcatggattttaatcaaagacatgcttaacgagttaatcataaaccagtttgaagggaatttacgtcatggcagaaacaaaaccaacttattatattacgacgccgatctactatccttcggggaagttgcacatcggtaattcatacacgacaattgcgtgcgatactttagcacgttacaaacgtgcgatgggttacgatgtttacttcttaaccgggacggatgaacacggcctcaaaattgaagaaaaagcagaaaaattgaacactgatccgaagtcatacgttgatgggatggcaaaacaaatcaaggatttatggcaattgctagaaatctctaatgacaagtttattcggaccaccgatgattatcatgaacgcgcggtccaagaaattttcgatcggttacttaaaaatggtgacatctacttaggtgagtacgaaggctggtactccgttgatgacgaagaatacttcactgaaacgcagctggctgaagttttccgtgatgataacggcaaggttattggtggtaaggcgcccagtggtcatgaagtcgaacttgttaaagaacagtcctacttctttaagatgagtaagtacgcagattggttgttagattattatcaaagtcatcctgactttattgaaccagctaatcggatgaccgaaatgatcaataattttattaaaccaggtctggaagacttggccgtttctcggacgagctttacttggggtgtccctgtcaagagtgatcctaagcacgtcgtttacgtgtggattgatgccctgacaaactatattacggcactgggttacgcaaccggcgactccgaagacttgtttaacaagttctggcctgccgatgttcaaatggttggtaaagaaatcgtgcgcttccatacgatttactggccaattattttgcatgcactcgggttaccattacctaagaaggtctttggtcatggttggttattgatgaaggacggcaaaatgtccaagtctaagggtaacgtgatttatcctgaaacattggttgaacattacggcttggatgcgcttcgttattatttagttaaagccatgccttatggtaacgatggtttattcacaccagaggactttgtggcgcgggttaactatgacttggctaatgacttgggaaacttgctgaaccggaccattgcgatgatcaataaatatgaagatggtcaattaccagcattcaaagccggtgtgactgaatttgacgctgacttagaagccacagctgccacgactattaagaacttcaacgcttgcatggacagcctgcatttatcagatgcgctggctgaagtgtggaagttggtcagtcggacgaataagtatattgatgaaacggcaccttggcaattagctaagagtgacgatgcgaatgatgctgataagttagccagtgtgatggcccatttagcagctagtttgcgggtgattgctagtttgatcagtccggtcatgacgcatgcacctaaggaaatctttacccaattagggttggacccagcaactttagcaattgccgacttacaactggctgatttgccggctggcgcacaagtcgttgctaagggaaccccaatcttcccacgggtcgatatggatgccgaagttgaattcttgaagggtaagatgacgaaatccgacaaacagaaggggcgtaaagccatggaaaacgcgaaacatgaagctgaagtcgaacaaggctggaacccagctgagactaatttgaacctcactaaaccagcgattaccattgatgattttgacaaggtcgaattgaaagttgctgaagtcattacggtgcagaaattgaaaggggctgacaaactcctacaattccgtttagatgcaggagatgctgatcatcgccaaatcctttcaggtattgctaagtggtatccagaaccggaagaactgattggcaagaaggttatcatcgttggtaacttaaagccacggaagcttcgtggtgaaatgagccaaggcatgttactgtcagcagaacacgacggtcaggtgcaattaattacggtaccagataatatggtaaacggatcattgatttcgtaaaaactaaatgttgagtaaaaaatcgggcgcactgactagtgagctcgattttttatttgtaattcaattgttattttagttgtttttgacaaatgggttaatctcccgtacagtagtacgaacaagaaatgaggtgagaacatatgaagtatgaacagattctcgtatgcgtctccgtagatggaaaaggacgtttttccgaaaattaattaaatttaggagacttaattaaatgaaaaacgtccaaaaacaagtgccatcattattactattaatcacattagtgggttttccacaaatcagtgaatcaatttttacgccgatcttgccagcactcagtcaggcaatgcacgttagcgccagccacagccagctaaccatgagcagttattttgtggcttttgcagttggggtgctcttctgggggcaatatgctgactatcgcgggcgccgtgatgccatgttaggtggattagccttttatttgattggtaacttagggttatatctgagcccgggctttacttggttattggtttgccgcttgatccaagctttcggtgctagtgctggttcggttgtgacacagactatcatgcgtgagagctttacgggtgttactggtgcaaaaatctttgcgaaggtgagtgcggccatggcactatcacccgctctcgggccactcatcggaggtggcgtccagactgtgttcggctatcagcatgtcttctcggtcttgatcatgatagcagtcgtaatactgttgtacgcggggtgttgcttgccagagactcgaccagaaacggtcaaagtggcctcttggcggcaacaaagcgttgtcgtttcacggttattgcacgatcccgtggtctggtgttacggcctattgattagtggtattaatggtattttgtttagttattacgctgaagcgccgtttatttttgaaacgcacttcggctttagtgctgtgcaatacggtagtctcggtttagtcttagccgcggccagtctgctgggcgcgttgctagtgaattggcttgtcaactattggtcaccaatgcaggtcgctttaagtggcttaggattgagtttggtagcggcagttggcttggtgatgaccgctgttggcaatcacgtcattgggatgctgattgggatttttctagccttcttaggtctgaacatcaccctaccaaacgcgttgaatcgtgctttgattggctatgaaacggtgatgggaagtgccagtggctggtttagcctgggttattatctactagtgagtgtgctaacttacttaatgagttggctccaccacggtagtatcgtgacattgcccgtatacatgttaggcgtggtcgtcgtgatgacggtggtgtatgcgggactgtattggcggcgtgtacgtcattaattttgcttgaaagcttggggaaacccaggctttttatattggcattgtttttaggtccagtaagacgttttgaaaaatcgtgtcccagtattggatgtgtaaacagtgcacaatatcaagtgcttgactacaggcggtcaatggctggttgggcttagtcacgtagtccgtaatgccctgacagaattttagtagtaatgctggacgagttggtcagagggaaagttgatcgttgtcattataggatatattttagtaattagcttgggctgtttatcgtgaacagcaacgaacagctggttggctagaaatgtcatgaaggttaaagcttcgtcagtcaaccgttgatatttgtggaaacttttattagcgcttgttaataggatgatttgctgctctggcgtaagagtggtgaagatttggcgacataacatcaaatcatatttggaccacagttgaagattcaataggtcttgaataagcccgtcaatcgctgctcgtaacgttgaatccagtgcctgttgtggtgtttctaggtggtgcaaagccaggtgggttagcgttagtaactgttgataacgatgagcatgcgttgcattaaatagcttgtcaatttgcttctttaatttccaaagctcgccaatatcttctttgacgactgcgttttggatttgttgcagcaattgttcaaccgggggaatttgatagtgatgtaagatgaagtcaaattcctgaagggtaagttctaaccgctctagtagctgtaaaaagcaaacagccgagatgttgctgtgaccgttgatgaagcgatagtaagttgactttgagataatgcgttcattgttagtaacatcattgactgatagtcttttagcatgctgaaccatcttgacagttgcaccgattgaagctgaattagacaaactggacactcctaaataactggatttgctgatgatttcccatatctgggaatttttctcgcttagaataattaatgtgctacattaaactgaacgaatagttaatgtggtgaattgaacattgcgtgtatcgttatctgatgattttgaacattctattaactattattgttttatgttagttgatggaattaagcattgaatgaaaaagattagaataatgtatgaatttttgaaaagagtactttgtgttaaagcaggtgaatgttagtaaccataacactgaggtgttgttactgaaaagtgtcgctattgaattgagaaaattaaaaccagtaattttgaatatcgttgagatgggttattggttttaatgaatatactcaaatttggaagatgtcaaaatatgaaatgttagcgcagatattgactttaaactaaattattcttcgaaaaagtcacaatacataataaagattgtttgaagtcctctcagcggttataaagtttaaattgatagtctccattcagcatcgataatagtttttgtaagggtgatttgatgaagcgctggaatcgattattacaacgtattcaagtaaaatatggcagtttatcagagcagcaattgttaaaaatcgattattggttattagcaatctacctagtcttgtgtggcgttgcctacattcgtctgcttcattcccgcagtgctgtgctccaagttgtgccggaattaataattactctaatggcatttggattgttgcgaataattagatggcggaaaaccacgcccaagagtcggtttaagtttgcgactgaggattattcaccagaagagcaattagtttttgtgatgattgtttttttagaaaattttccgacccccgtggtaatggaggtaatcggaaatattttatttattctgattagtattcggaaatttttccaatataaactggaccgattatcagcgtatcgaacgttgaatattatcctggtttttgaaactgttatggttagctggatcgtcctatttggtggataaggcagtgctcgtgaattcaatgattggcatgggctgagattgaagaaaagtactgtgaatttttgtcaatcattctagggactgtctgaaaactnnnnnnnnnnttttaagacggaccctagttagaatatagttagttaagagggtgcctagtgcagcctctttttatggctaatgactagtatgtcgttattagtttgcaagaaataggttggatggcccgtcttcttttccgaaaacttgcgtcccatggtaaaatcaactaagataacaaaagtcgaaaaggggttattacatgcggatttttgattctcatacccatttaaatagtgaagaattcatccaggaagtgccacgttacttacaacaagcggctgaccttgatgttacgcggatggcaatcgttggttcgaatacacaactgaacgccgatgcgattaaactggcggaaacgtatcctcagttagtcgcgattgttggttggcacccggaagatgccaaaaactatgatcaggcggctgaaaagttgttgattgaacaagtccaacacccgaaagtcgtcgcgttaggtgagattggactggactaccattgggatacgtcgccacaagacgttcagcggcaagtctttgcccgccaagtcgccattgctaaagagatgcaattgccaatttccgtgcacaatcgtgatgctttcgaagatacctataagatcttgaaagcagctgatattcgtaacacgggtggcgtcatgcatagctttaatggtgaccctgagtggctcaaacggttcttggacttaggtatgcatatttcctatagtggtgtcgcatcatttaagaatgcgcgtgaagtccatgaatccgtcaagcaaacgccactaacgcaaatgctggttgaaacggatgccccttatctaacgccggaaccataccggggaaagcagaacgaacccggttacacgcggtacgttgttgaagcaattgccaagttacgtgaaacgacgccggaaattatagcggcccaaacttatcaaaatgcagaggaattttttaagattgaaaaagattaaagaagtaattgtggttgaagggaaagatgacacgaagcgtctcgccctagctgtcgatgcagatacacttgaaacgaatggctcggcgatttccgaagccaccttagcccagatcaaaacgttgcaggccagtcgcggcgtgatcgtgttcaccgacccagacttttccggtgaacgtattcggaagacgatttcggcggctgttccgggtgtcaagcacgcctttttgccccgcaaagctggtgtaccaactaaggctggggggagcctgggcgttgaacacgcgagcccagcggcgatccaaactgcactcgcccatctatatacggagcaaatcgacgagccccaacagttgatcagtcaccatgatttgattgcggcgggcttactagcgggtcccacggcgcgtcaacgacgcgaacagttgggtgaacgtttaggtatcggatacgtcaacggtaaacagctgcccaaacggttacaactatttcaaattcagccagctgatttttgggcggctgttgaccaactaaccacagaggagaaatgatgagtagagatttagatattgcgaatcccgcccgcacacgggcaattatgcatacgtacgggttacaagttaagaagagtttaggacagaattttttaactgatcagaacgtgttacacaacattgttgccactgctgacattggaaccaatgatgacgtgattgaaattggccctgggatcggcgccttgactgagtatttggcacgggatgcgcaccacgtcctggcctttgaaatcgatgatcggttactgccaattttggatgagacactagctgattatgacaatgtaacggtcgttaaccaagatattttgaaggccgacttagccgcgatgatcagtgaacatttagataacgagcggccgttgaagctcgtcgccaatttaccgtattatattacaacgcctattctgatgaacattttggcgggggacgttgcttttgaaaatattgttgtgatgatgcaaaaggaagttgccgaccgtttggcagctgaaccgggtacgaaggcgtatggtgcgttaacgattgctgtgcagtaccggatggctgctgagatggcgatggtcgttccccggacggttttcgtgccgtcaccgaatgtcgattctgcaatcgtgaaattgacggcattgccaccgcggacacacgtgccatttgacgaagcagcttttttcaaggtcgttaaagcgggctttgcgcaccgtcggaaaaatctgtggaataatttgcaaagcctatttggtaaacaacctgagacgaagacggccattcaacaggctcttgatatcgcgacgattgatcccaagattcgtgccgaacggttgacggtcgatgaatttattacattgacggatgcgttacatcaggctgacttactttaagttatctatgcttataaaatggttgcacattagaaaaccttgtgatataatattgacttttttgtgaaaagctagtatagtgtctttcatgaggaggattctcaatgccaatttcactagctgcaattaaagataaacttgactcacggatcggccaacgcatgaaggtcgttgcccaggctggccgtaagaaaacaactgaacgccacggtatcttgaaagaaacttatcgttcggtgttcgttgtggatttagatcaacaagaaaacgcatttgaacgggtctcctacagttatactgatgttctgacaaagaacgttcaaatcgcttttgatgatgaaacaactgaagcttaattcgcgtctcgtgaattctcaatattaagacccccaagcaaggtctttttattttgccttgatattagtataattgtatcaaagtaagtcagcgaccccgggtaatcgcggtcatggaagagggtgagacgcgtgcagatcgttgaaaaagcaccggccaaaatcaatttaggactggataccttatttgaacatccaaatggggataaagagtgggacatggtgatgacgtcggtcgatctggccgactatgtcatgttagaatcattgcatacgaaccgaatcgaagtggtcaccgatagtggctttttgccgaatgatcgccgtaacttagcttttcaagcggtgagtgttttaaaacggtattgtcatgttgatcggggtgtccgtatcaaaataagaaaggccattccggtagcggctggtctaggaggcggctcatctgatgccgccgctgttttacggggcttgaaccggatgtggaatctccacttggacttagccacgttagcacgtttgggattgcaagtagattcggatgtgccatactgtgtctacagtcagacggcccacgtgacgggaaaaggcgatgtggttaccccactgcctaagttgccgccgatgtggattattctcgcgaagccgaaagtcagtgtgtcaacgccaaatattttgcggcaggtcaattacgagcgcatcgaccagcatcccaatattgaggccttgttggctggtattcaacagcaggatttcgcggagatttttgcgaatatgggcaacgttttagagccaatcacggcaaaacgctaccccgagattttacagatcaagcggcaattgttaacgtttggggcggatgcggcccagatgagcggcaccggaccaactgtgttcggtgtgtgtcgcaaacaatcgcgggcgcaacgcgtgtataattccttgaagggtttttgtcgggaagtataccttgtgcggccagttaatttaaatgaacattagaccgtagtagtccgccgtgatggtgggctttttttattggtacggggttaggtgagccgagtctctaatttactgctacgcttaaacggtagcgctgagccatttgtcatcacgacctgtgtccagccagagatggtgtagcagtgcaattggcaccggaatgcgagtagccgcggctttgcttgcaggttgacacacgaagatggtcgttgccttcaacgcatcatcggttattcggacaacgcaatctctttttgtaagcaatttatgcgcgtttatgattaaataaggagtaacggaggtgttcggatgaagcagtcgacaaaatttggattgaaattggcgggcgtcattggtgctgcaacttatgcgggaacgttacttggtggcttagcggcgtatcaagtcgcgatgcacgtgagtgacgcacagaagcagcagggccgcgaacgttcgcgggcagaaaacactgaaattgagaatttttggtatttcaagcagcctaaacagcagtggatgatccagtcctttgatgggctgaacttagtggcaacatatatccctaatccgaaaacaattggccgcttggcgattttggcgcatggtctaggacattcgcgcgaacaaatgattccgtatgcgcgcatctttatgagcttggggtatgacgttttaatgcctgatgcccggtcatttggtgatagtcaaggccatacgattggttatggttggctagaccgactagattatgaacgttggattacgatggcgcttagtcaattaggtctggatattgacatcgtattgatgggaatttcgatgggggccgccacggtcatggcgactagtggtgagccgttaccggagaatgttaaagctattgtggaggatagcggttatgcggatctttatgatgaagcgaagttcagactgactcataagttccacttgccagcctatccgattatgccggtggcgaatcgcttagcacacgttcgcgcgggctatgggtttaaggatggccggattctgcaacgggtgattgatggtgggttaccgatcttgatgattcatggttccaaggatcagacggtgcctgtccgcaatgcacataccttgtacgaccagttaccacaacaaaagggcctgtatatcgaccccgatgctggtcacgttgaagccatccgaacgcacccggatcgctatcaagaagtgttggatgaattcttgcatgagcaggcggggttggcttaagcaccttaaattaaagtaatgataaacatgaattgaccgtgttttaccggcttaatggtaaaaacggtcttttttttgcaatctcgtcttagtgataagcgcattcaactagtggtcaaggtgttatttgattaggccccgatgattgccgcagctggtaatgattacggcattttgaactcaggtattgacaaatcaccgcattcaggtaaactaaaatagtaatcattacgatttactttaatttagaaagttggggtagtgttatgacggaaccgttaattgccgtccaacaccttggaattggctttccaaacaaccaggtgtttaaagatttgaattttaacattgaacaaggtgactttttgaccgtgattggtgagaatggggtggggaaaaccactttaattcgcgccttgcttggcatgctgaagccaacagccggtcaaattaagtattatccgaataaaaaagccattaaaattggctacgtgccccaatttcgcaacttagaccaggagtatccgttaacgattgaggactttgtcgggctgaacctaaaagggtggcagccgtggctgtctcgagctgaacatcgtcaggtagcgacagcattagccgtgaccaatttgaagaaactccgtcagcgaccgcttgggatggcttctggtggtgaaaagcagcgggcttacttagcacaagcaattgtgcaacaaccgcagctattaattttagacgaatcgacggctagtttggacaatgaaatgaagtatgaattgttggacctcgttcagaacttaaaccaaactagcaacattaccgtcttctttgtgacgcacgacttgccattagcgaagcaatacgccaaacattatctggccttaaagcccggccaccagcaatttggcaatatcgctgatatgtcggtagagcaattaaaggaggccactaatgtcaatgtttagcttagtatttatgcgaaatgcctacttagcaggaacctttattgcaattatttgtgggacgattggcgttttcgtgattgcccggaacctctcatttctgacacacacactgtctgaaattgggtttgccggtgcagccttcgggatttttatgggctggaccgcgttgagtgggatgctgatttttaccgtgattagttcggtcatcgtggggcagatgagtgtgaaacaatcacgacgcgaagcctcgatttctgcaatttccgctctgtttatcggcttagggattctattcctgtcgttatctaatcaaacttcgagttatgcgacgagcatcctgtttgggagtgtgattgggattgccagtgcggatgtcatccgggtcgcaatcttatcggccatcgtcctactcgtgatgttgggcttgtaccggccactcaaatttgattccttcgatgcgattggcgcccgggtgagcggcttatggacgaccggcatctcagtggtcttcttggtactcgttgcgatgagcgtcagcgtggctgcccaaattgtggggtcattactgatctttatcttactcacgttaccagcagcggcagcgcgatactttgtccatacggttagcaagatgatttttctagcgattggtttcgcgttgattggggtttggctggggctgtacttgagttacgtcacgaatttaccagtcagtttcttcatcgctgcaatcgagtgtatcttctactttgccgcgctgggttatcagcgacttcgggtcggaagctagtggggctattcttgttcagctgtatcacgttaaaagtaggtagtttacagaattaagtggttcgttgtgacacgctaaaatgttactagggactgtctgaaaannnnnnnnnnagttttcagacggaccctagtcgtttctggaattcattgggaattctagagcggctagttttttgttcgtgttggggttgcaacttttcgtttgcgtgggggggcaagtcacacaagaagttttctaaaagcataagtccaagggtagcgctgtaattgccacacttagtcgtaggacgggaatcagtaaaggtatcatttcgtttttgacggatatgattgggtataatgatatttataccattattacggggaaagatgcgctactggtaagaagcgttctcgtttgaagggtgcgttttggacagccttgaactttgtgccggtcgggcaactaagcaggcaatgaagcgtgcggctgaggaattggccaaacgtaagccggctaggaagacgaccaagaaagcagccacgaagtctcacaaaactacaaagaccaagcatgggacatcaaaagtctaagccccaaaagacttctcatgcgacaaaacacaagaccaagaagcacaacagaagcgctacaataagaaaaaagttgcgggcaaggcaagaaaagcttctcagagaaaacaatcctcgcagaataaagatagtcatgggaaaaaggagaaatctagcaaggaaaaatcttcaaaagatgggaaagataaaaagacaaataatgtcccattggaaaatggctcttatattaggaacggaaaaccttatggacgaccaacattaaccgggaagaaaaaactcgaattcgagcaggaagtatataataggcaagctaaagatggagtgcttattgatcgaaatacgaaacaagtgatacattggaagccgggctaaccccgaaaaggaaaggtcgatctcggacatctaccgggtaagtcttataaggaaatgttcaatctatataaaaataggaagatgacattgaaggattttcaatttaatcccaaaaactctagattagaaactccgtctgctaatcggagtcataaatatgaaacgaggtaaaaagtgtgctagtttacaatgcttttagtgcggtaagagatggaacatttgatcagtttaaaaattattattctggcaatgtggatgagactgataagtttgaaggacttaatttattatgcatggcaatgacaaacgatgacaatcctgaggaaaagttaaagattgttcattttttgttacaagcaggtattgatgttaactttgtcaccaagagtgaacatcgaaacgcattacattatttttacaattgtgtatggcgtccaaatcctaagtttgctatggaaattacgaaactattagtcgagaacggcatcgatgtaaatagcgttgataagtatggacatgtaccactgttttatgcggtttttgataatgatttggatactaaggaaaatgaagagttatatttttatctattaaaggcgggctcagattatcgtttgcgtgatccatttgggaaatccattatagattatgcacgagaaaccaacgagaggactgattttttagatattgtaaaagagtatgaaaacggcaaaaaatgattgcaggttgaaaaatggcaacgattataattattggagtagtaattataggaattacgctgggattaggatactggagttatttactgggaaaaaggaatcaatctaattttgttggccctattattccagtagcttactttgctgttcgagcaatcttagctgtgatgacacaaactacgacacatgggctagtatcgtcattactcggtagcttgttattcagtttgatttactatggcttatttgttgggggtaagcaccgggccaataagtaacatgaattagtcagattaagataaccgatattcgacaaggactaattgccgagtatcggttattttatagaaaagtttagtcggtaatttggtaattactgttgtctatatcctattgtttggggacgacaacgattcaataagcagaagccaataaaataaattgcttgaaagctcagaacgattccaaaattactcgttctgggctttttaggtgtaagtagcgaccaatcaatcgaactttctggacgctacgtcgtgtgaacgatggattcccctggcacattccgtatctactccgttataagttgcctaagtttattgttctcgaattcgccaaatatgagctgtacagacaagataattggcaaacatattaagaaattccgatggtttagtaaaaaaatgtgaaaaaattagcttatttccgaacgtttgtgttatcattttgcatagactttaaaaatgatgatttaggttgaggtggaagttatgaaagtacgtagaagcgaacgtttaatagatatgacgcgctatttgttggaacgtccccatacattagtttcattgacatacttcgcggaacggtacgcatccgcaaagtcgtcaatcagtgaagatttaacaattttgaagaaagtgtttcaggcccggggaacaggaatcttggaaaccattcccggtgctgctggtggtgcacggtttattccttatattttaaaggaagaggcccaagaatttattgacgagatgaccactaaggttgccgacaagagtcgggtgttaccgggtggctatgtttatttatctgatattttaggccaaccagatattttgcgccaagtgggtcgggtgattgcgactcagtacttgaatcaaaaaatcgacgctgttatgaccgttgcaactaaaggaattccgattgcccaaagtgttgcgacttatttaaacgtgccgtttgtgattgtccgcaatgattctaaaattacggaaggctcgaccgttagtgtgaactatgtctcgggttcttcagaacggatcaagaagatggaactttccaagcgaagcctaacggaaggcgccaacgtgctcatcgtggatgatttcatgaagggcggcggcacaatcaacgggatgaagaccttgattgaagaatttgatgctaatttaattggcatcaccgtttttgccgaagccagttttgttggcaatcgtttaatcgatgactacacgtcgttattacgagtaaccaacgtgagtgatagtgacaaggcgattaaagtcgttgctggtaactatttggagaaggttttcggtgcggaagtctagcctggtgtgttatccagaccagttttttgatatgatggacttatctgaggactaaggagtaatttgtaatgacaaccaaaaatgcaatcatcatggccgctggtaaagggacccggatgaaatccaagctagtcaaagtattacatcaggtctgtggcaaatctatggtcgaccacgtcttgacccaagttgaagccacccacatggcaaatatcgtgaccattgtaggccacggtgccaaagatgtggaagcagccttaggcgaccgaactgagtacgcggttcaaacggaacaattaggaaccggtcacgcagtattacaagccgaatcgctcttaaaagatgcggatgggatgacgctgatcgtcagtggcgacacacccttatttaaagctgaaacttttgaagaactatttgaatatcatcaagctaagggtgctgctggcacgattttaacgtccaaggcacctaatcctcaaggctacggccgggttgttcgcaatcggttaggcatcgttgaaaagattgtagaacaaaaggatgcgactaaggaagaacaagaaattcatgaaattaacacgggagtctactgcttcgataatcagaagttgtttgccgccttacatgaagtgaccaacgataatgcacagggcgaatattatttgactgacgtgattcagatcatgaagaatcagggtgatgtggtcgccgcctatcaaatggatgattttgatgaatcaatgggggtaaatacccgtgcagctctagcccaagcaaccaaagtgatgcaacaacggatcaacgcgcagcatatggaaaatggggtttcaattatcaaccctgacgatacctatattgaagcgggcgttaagattggtgctgatacgattattgaaccaggcgtcttgatcaagggccatacgacaattggtgaagattgcttcatcggcgcgcactccgagatccatgacatggtgattgaagatcgtgttcgggtgacggcttccttcttggaagattccatcatgcacgctgacagcaatattggcccgtatagccatttgcggccgcaagctgagattggtgaacacgtccatcttggtaactttgtcgaagtcaagaaggctaagatcggtaatcggaccaaggtcggccatttgacttatgttggtgacgcaacgttaggtcaagatattaacgttggttgtggtgtggtcttcgttaactatgacggagtcaacaagcaccacacgaatgtcggcgattccgcctttattggtagtaactcgaacatcattgcgccagttgaagtggctgaccactcgtttatcgcggctggttcgaccattactgatgatgttaacttccatgatatggcaattgcccgggcacgtcagacgaacaagcctgacttctggggccgcttaccacatgaaccagaaaacatgtaattattatcattgataattgaattcagagaccatccaagtgcgttgttgctgggatggtctctttttgttagctcatcggcgtgacttgtggtgtaataagggctatttagctgctaaataggacaaagttgatttgactgtgtcagttcagggcaactgagtgattttaattaagtcacgaaattggtataattggcgaggagtttacgggacggggaagtttggaggcatttagatgcagacgaagaagtggattcgcggccttgtttgtggtctggcattgcttggcggttggagctgggcattaccagtacacgcaactagcgttaaaagtgagcaaacagccgttaaaaagatcgcgcaacgtgatttgaaatcactaggtgggcgctggtcggtcaaggtgacccgattaggtcgacgaaaactaaccgtgcaaacgggaaatcagcgcatgactcgtcaacgttctgctagtacgatcaaagtttatgttatgctgacgatttatcgacgggtccaacaacgaaagttacggctaacacagcaagatcaaaatgatttaaaattaatgattcataattccgataataacgcggctaaccggttaatcaaacgtgcggggggcttcaggagcgttaatgcggccattaagcattatcgattcaagcagacggttttacaacggtatatgcttgatacgaacgcgctacgctggggacgcgataattacacgtcggtggctgatctaactcgttttttaacgctgacatatcaacataagttattaggtaagacgtatgataagaagatgctgaccttacttaagggctgtcgcaaccacagcaagctaccatacttagttaaacacgccacggtctataataaaactggcgaatatcccgataagggtgtccaaaacgatgcggccatttttaagaccaaacaaggcacttatagcattgtcgtcatggcccagaatggcaagcagtaccaacaatatcaagggatgaatcgcttggggcgcgatgtcgtgacttatttaaatcagcaccactgagtgtgtttagataactgaacagtctagtagattcctgttcgtcagccggtgtgcgctctattccgacttctagtactggctacttttgaacgcgagaaacggcagcggtcaagtaccaactaagacaataactagtgcaatgcgtgtgtcagtaccaattacaactgatagcggtctcattaactaagattgttcggtaatcggggctcacgaaactttaatctttaatcacgaaggggcttagattgccgaaagtcgtgcttccagcccagtctcacgcaattttgccttgttgttgggacttgattttcactagcaaaatgcctattatttagtaagtaataaattttcgaatggaggaaattatgtcagaacagtattttgatccaaagttaaaaatctttgctttgaattcaaataaaccattggcagaaaaaatcgcggacgccgttggggttaagttgggtaagacttcggtcgatcgctttagtgatggcgaaattcgcattaacattgaggaaagtattcgtggtgatcaagtttatatcattcaatcaacttccgctcccgttaatgacaatttgatggaactattgatcatgattgacgccctacgtcgcgcgagtgctaagaccattaacgtggttattccttattacggatatgcgcgtcaagatcggaaagcacgttctcgcgaaccaattaccgctaagttagttgcaaacatgctggaaacagccggtgcaacacggattttggcactcgatcttcatgctgcccaaattcaaggcttcttcgatattccgttggatcacttgatgggtgcgccactgttagctgactacttcctgaaccaccacttggatgaaaatgctgtggttgtttcacctgaccatggtggtgtgactcgggcacgtaaattagctgaattcttgaaggcaccaatcgcgattattgataagcgtcgaccacgggccaacgttgccgaagttatgaatattattggtgatgtcaagggtaagcgggccatcatgatcgatgatatgatcgatacggctgggacgattactttaggtgcacaggcactggttgatgcgggcgcaactgaagtttacgccagttgtacgcatccagttctgtctggtcctgccatcgaacggattgaaaagtcaccaattaagaaattagttgtgacggattcaattgaattaccagctgctaagcgaatcgataagatcgaacaagtttcagttggtcaattaatgggtcaagcaatcaagtttatccatgaaaataaaccagttagtccattatttaagaatcgtttccataacgaagaaaattaattgacgaagcgtcaaattggcaattgctgatttgacgctttttaagttgcagtaatttctaaaagtgatagagtaaaggtgttgtttggtgggcattatgacctagtcaaggttggactggacgccgtatatcaacgaatctttcgttttggcgtgcttcaacattaattaggtgatggcgcggaacggataacggaccaacgtcgggctaccggcgtcctttttttatccaataaacactagcacgaatccttaaaatgattacaatataagttaagggggtgttgcgatgacaccgttttattggggtagtttggcccttgctagtgcgttgaccttgcaattgacggaccggcggcattggttaacgggacatctttttttgattgcagtcattggcattttgttaagcgcttaccatcgattcagtgcgcaggcaagtcctacttggcaattcatgttggtcggtgcaaaaattttggcttatacgttgttgccaattgtaattttgattgtgggcattagttttgtcaggtatagttaccgattgattcgcaaggagggctgggcgtttcattacagcttgctagcaatcgtcggtggtgtattagtcataatgctggtcttatcagtaatcaacttaggagtttggcattcgcgacgcttgtggcagttattaggcctagcgttattattgacggcgtattttgcgttcagctttatcgcgtatctattagcttgcgtcatgacccgactaggacgtcatcgacagatcgattatatgatcgtcttaggagcagggttgatgccaaatgggcagccaacgcgaacactggcatatcggcttcaggcggcagcgaagtactatcgggtgcaacgggcgcgttatcatcaaccaatcacgatcgttgtttctggtggtcagggaccggatgaggttatggcggagagtaccgcaatgcggcagtacttagtggatcaaggggtcccccgtgatgccattcaagaagaaaatcggtcaacgtcgacaattgaaaatctaaaattttcgcacgcattaattgtgcggcaacaaccgttttatcgcgccgtgattgtcacgagtggctatcacgttttacgggctaatatttttgctcggcaactgcacctgaacctaacgggaatcggtgcgcacacgccactgtattatttaccgtttgctatgtttcgggaatacttggccttaattgtgatgtatcgctgggccaacttagtggtggtacttggtttagcggcttattatgtcgcagcgttagttaggttaatttaacaaagccgctactcagagctttgaaaaaaatgacattgcgattaatggtataatggagaatgataaaaaggaggggtttgccgtggatcatgcctatcgatcatcttggccactgattgtaatcgtcctactcggattgattacactttcaggctgtgccaaaaataccggaggcgtaaccgcaagttcggcaacgaccgcaactggtaacagtacaacggccgttttaaccaaagctgatcagcaaatttcgcaacaaaaaattgccgctgcccagaagactttagcgggtgcttctgaatcaactccagcgatcaaaaagttagcccttgggttaaagtattatcaggaagctgaagaagcacttgataataatcagctcagtctagcaaagggttattttgacacgttaagtagttatgatggcacgactgacgccagttttattgctgctcggcaaaagctcgtcaagcagtaccaggcggtcaagctagccaatggttactataacgctgcccgtgatgaattaagtattcatgatttggccactgcgaaggccaatattgataagttggacgatgtgcaagccacacatccggttatcaaaaaattacagaaaaaagctttggcaatgaaacaagccattatgaattatgaggcgtcgcaatcaactagttctggtagtgatagctcaacggttgtcagttcgagttctgcggctagtgcgagtgatagtaggacgtcttcaagcagtacgagtagtactagtgccgatagttcaacgatgacgagttcgtcgaatagcagcgcgtctgccagcagtagttcttcagagctgacaacttcggcgatcatcaaacagtttcaggatgcgtccggtgttacgtttacttcggataccgaatttaatattactaaggagaccagtgcttattatcagattaccgcaatctatgcgacgaatgagtctagttcttctgcttccaagacagtaacggatacttatcgttattatccggatagtggtagtgttactaaggaaaatagtgcaactggtagtttcgaataaccagcattaaaaagtgacgatcaggtaatgactgatcgtcacttttttgtttgactggattgtttagaaaacgctgggtaacggtcataacagtgataaaaaagcaacgctcacggcacgttaaaaacgagccattagcgttgcttgaattagtttgaaaaatagtagcttaggcgagtgcccaagtgttaatggcgtgtgcgaccccgtcttcaacgttagtcttggtttcataacgggcaatttgcttggcctcatcaatggcgttacccatcgcaacactgttggttgcgtaacgcagcatactcaaatcgttaccttgatcaccaatcgccatgacttcatcagcagttaagttcagatggtcggtcaacgtggctagggcgttacccttgctagcggcgggattcatgaattctaggaaatacgcttcggagcgaacaatggtaaagcgcttggagaatgacgctggtaattgcttgatggctgcatccagtagtggggcgtgatcgatgaacatgcacttgacgattggtaagtctgggcgcatttcttccggtgtccggaaccgaatcggcatattgacgagtgcactttcgccgaccgtataagggctgatatttcgattggcggtgtagatatggtcttcactttcaacgtgacaatggatatcgagttttcggctgagcgtttcaatgtcgatgtaatcgtcatgtgacagggtaagtcctgtgatgatcttaccggtgattgtctgaaccattgagccattaaaagtaatgacgtaattatcttcaccagcgattccaagttgctttaaaaagggcgtgacgccacttaatggccgtcccgtacaaatgacgactttgattccttgcgcgttagcggcgttaatcgcttgaacggttgcgggatttagttcgctgtgctcattgagtaaggtgccgtccatatcgatggcgataagcttgactgacataataataattcctccaaaattagtgtggtacgaccagacgatcgtttaaaatatattgctggaattcttggtaaattggtttgaataaatcgttttcggcgtttttgctgagcatttcttttggaaagaaaaaccgctgatcgccagagactttcccggtgatggctcgcactaggtcactgacggtggatagttctagtaaggaaccgtctttttgttgcagttcaatctgggtacgcggcttcttcatcttaggatcgtaggcgtcgtaagggagatcgtaactgtcgttgatgtcagtgtagtagtgcgtatcaaagccggcttgttcaattaatttttgtaacgttggaattagcggttgagtcgttgcatcgactcgtgctgattttaagggacgccggtctaagaaacgggttgctaggtcagcgagaatttgatcacggctatcacgccaatggctaaaataagtgtttaagacgccatcgtctaaccgtaaataatcgtgtaacgtaaagttattattgaaaaacggcaataatatcactggtgtggcttcagcgtcgaccgcgtggctttgataaagatcgttagcccgttccagtaggcgatctaggatgacttccatggaacgtgatactggatggaaatagacttgcatgtacatctggaagcgactgacaatgtaatcttctaccgcgtgcatgccttccatcgcaaatgtaatgccgccttgatacggcttcataacgcgcaaaatacgggtcaaatcaaaattgccgtaattcgtacccgtgaagtacgaatctcgcagtaggtagtccatccgatcggcatcgatttgactagaaatcatctggacgacttggggattcgggtacgttttttgaatgacggccgcaacttgggccgggaagtcaggcgagacttgctgtaagacctgattgacctcggtttcaggtgatgtcaaaatctgaacagttagggcttcatggtcggtgtgaaagatgtgctcgaatgtgtgtgagtatggcccgtgaccgatatcgtgtaacagggcggcgcatagtgcgaccaatcgctcgtgatcatcccaaccaccgtcaccaggggcctgggtcgggtagttacgttcgaagttatcgcaaatacggcgtgtaatctcataaacaccgaggcaatgtccaaagcgggagtgttctgcaccgtggaaggtcagcgaggtcgtaccgagttgcttaatacggcgcagtcgttgaaattccgaggtgttgatcaaatcgagaatgacttgatgttggatataaatgtaatcatggaccgggtcacgaaagactttctccatgggtaatagttgctggcgataggccaaattaattccttctttcagtgatgcaagcgttgttgtcggcgttgcatttgttgataggcttgatttaagtgtgcttgaaattcaggttcttcggtgactaacggcaaacttgttgtgtcgaccgtcccatgttgagctaggatggctataaaacgagcttgtgtagcggtagtgtcagtcggcgctgccaaagcgtcagcaacggtcgtcatgacttgtggatcaacatctggaaaccgcgcgtcatggtgaccggctaagctgacttggtaaaaacgctgaatgagttgactacgggccatctgatcgccatcaacgctgacatacagcatgatgaccagcgcttcggcagtgcgccgttgcgacattccggcaattttacgaccggcaatactcaaatcataatcaccaggacaataggagcgtgtaatctcaccagtcgtgatatttaattgtggccaaactgcctgaacgtagtcgaccatcaattgatatgccgctgtaattggatagcgttcacgagttgctggaagaaataaggaaacgtttagtacaccagggtcagcaactacggctagcccacctgaattacggagcatgacctgataaccggcagcgtgtagatctgctaagccagcagttagccgtggcaagcgttggtctaataagccgagaatgacggttggctgtaactgccagaaatgaacgattggttgctgacgagccgccgttaaccacagcaaggcgttcgtatacgcaaaactatccagcatcgctgccggttcgtatttttgactcaaagttgcaattgttgattccgtcaagaaagccaccccgttatccgctattatcgggcacgagggatgtctcatgatgaaaccgccaccgttgtccgtatcatcactaattatactagaaaaatggtaccgttgcattggcttagacaaatcaacttaatctgtagcataccatcataggataatgaaacgtgcaagttagttggttttttgttcgtcagcaacgtgcggcctatttcgacctccggggctgagggacaattgttggaacacagccgactcaaaaagtttacgcgggttcgaacttttcccagcagatctaagctgaccgcttttagtcctatttttagttattttggcatgaatggcttataattaaacaggaagttttacgatgggcgtgatgggagtcgcgcggtcgtgaacgctgaaaaggatatagcgagtgtggtaacacggtgatcgtagacgggcgttcagcgtgtgattttgaaatattaggaggtccaaatatggatgatttaacaactggtgtgccagtggcgattcatttagagacgcaggcgcggcaagatgacgatacggcgaactatgcactggatgtcgatggtcaattggttcagatgggtgacgcgttttatttacggtataaggaagttaacgatgatgcgccagaaccgattccagtgacgattaagctggcagctaatggggacgtcgtgttgacgcggagtgcggagaaccgacttcggttgcacttttccaatggtaaacgggtgcgtgctcattatcaaacgcctatggggatgctacctgttgaaacggtgacgccgatgttacgagtacggctacgtgaacggccattttcaggtgaggtgaacgttgattacgatttatacgcgggtgagcagctacttggtaactacaagttgcgattgcaattcacggcctaatttggtattatgtactataaactgtggaaaggacgtgcaccagtttggaactaaaacaatttgatggacaaaaaaagtccgaattatctttaatcgaggttgctcacgcgatcttatcacaacatggtgatgtgatggcttttgccgacttgaccaacgctgtgcaatcatatttaggtaaaagcgacgaagaaattcgggagcgtttatcacaattttataccgatcttaatatcgatggtagtttcatttcgctcggtgacaatatgtggggcctgcgtgcatggtacccatttgaatccattgacgaagccgttattcatacggacgatgacgaagatgaggatcggccaaagcgcaagaagcgtaagaaggttaacgccttcttggccgatgccggggatgatgacgacgtgatcgattacgatgacgatgatcccgaagatgacgataactacgatgacgatgatgatcaggacgacgatactgatgattcagcaagcagcaagtacgatgaacttgcgggtgttgatgacacagacgacgatgttgctgatgaaacgttgccagacggtatcgagggtcaattatcagagttaaatgatgacgatgatgatgacgactacgatgacgaagacgacgaatcgaaataagcttttcaagatttttccttgacgaaaaggaaatctccttgtattatcttatttgggctctctggtagaaatacctgagacaaacgatcgtattagctccctatttctgttgaaatagggagctttctttatttataccaccccacgaaataaatctttaaggagttatcacatgaccaaatatatttttgtaactggtggcgttgtgtcatccattggtaaaggtatcgtcgctgcttcgctagggcgtttattgaagaaccggggcttaaaggtcacgattcaaaagtttgatccctatatcaacgttgatcctggtacgatgagtccttatcaacacggtgaagtcttcgtgaccgatgatgggaccgaaactgacttagaccttggacattatgaacggtttatcgacattaaccttaataaatattcaaatgttaccaccggtaagatttattcagaagttctgcaaaaggaacggcggggcgattatttaggcgccacggtgcaagtgattccgcatatcacgaacgctatcaaggaaaaaatcatgcgtgcgggtacgacgacggattccgatatcgtgattactgaaatcggtgggacggtcggtgatatcgaatccttgccatttattgaagcgctacggcaaatgaagagtgatttaggttccgacaatgttttctatatccataccacattgatcccatatttacgggcagctggtgaaatgaagacgaagccaacgcaacattctgttaaggaattgcggagttatgggattcagccgaacatgttagttgtccggactgaacaaccaattacgcgggaaatgcggaataagattgcgtccttctgtgacgtggaaccagaagcagtcattgaatccttagacgttaagacgatttattcaattccgttgaatgttcagaaacaaaacatggaccaaatcgtccttgaccattttgatgtacaggcacctaaggccgacatgagtgaatggattgacttagaacatcatgttcagaacttatcacggaccatcaagattgcgctagtcggaaaatacgtcgctttacaggatgcttatatctcagtgacggaagcattgaagcatgctggctatacggatgatgccgacattgatttgaagaagatttctgctgaagatgttacgccagaaaatgtcgaagaactactcggcgatgctgacggaatcttagttcctggtggctttggtgatcggggaattgaaggtaagattacggcaatcaagtatgcccgtgaaaacgacgtgccattcttaggtatctgcttgggaatgcaaatggccagtgtcgaatttgcacgtaacgtacttggattgaaggatgctaactctgctgaaatcgatccgaagacgccggacaatattattgatttgatggccgaccaagaagacgttgaagacatgggtggaacgcaacgtttaggcgcttacccttgcaagctgaagccgggaactgtggcggctaaagcttatcacaatgaagaagttgtgatggaacgtcatcgccaccgttatgaattcaataataagtatcgtgaagcaatggctgctaagggcatggtcttctccggaacttcgcctgacaaccggctcgtcgaagtgattgaattaccaaagaagcgcttcttcgtggcctcacaatatcatccagaattcttatcacggcctaaccgtccagaagggttattcaaggcattcatcgatgccgctaaccagactggtaaagtgaaggcataaatttagtacggtagaattaagaataaagcacgccagcgaattgttggtgtgctttttttgttgggcggccacgggcttgattaggtcaccgatattcacagtgacaactggtgttgcgaaaatacatggtaacaataaatggttctcttgataatagaaaaataaaatgataataaaaaactattgacaataaatggcgggaggtctagattataagtgtgaattgaaagcgcaaacataatgggttagtagttaatctggttatttagaaagccaacggttgctgaaagttggttgattggactgatgaatccgccatttagcgtttgacttcatttttaagaggtcgcggtgagacgatatactcgtagagcagtaaattgggtggtaccacgttgataaaaaacgtcccatagtcttttaggtgaagactatgggacgttttaattttaaggaggcttttcgtatgttaaatccaaagtttgttcgtaataacccagaacttgttaagactaagctccagactcggaaggttgatccggctgaggttgatgaatacttacagttagaccaacaaaaccgggatgcaattaccaaggttgaaggattgaagaaacagaaaaaccagttgacggaacaaattgggcaaagtgatccgcaatcggaagcgggccaagccctcattcaacaagtcaaacagctgaatggtgatattaagagtacggaagcggcccaaacggaagtaaacgatcggcttcattacttagcgattcgcttcccgaatttacctgccgatgatgtaccagtcggtcctgacgaagatagcaatgttgagatgcgtaagcacggcgatattccaacgtttgattttaaacctaaggcgcactgggaattgggcgaaagcttaggaatcttggattttgaccgggcagcaaaagtcgcgggcgcgcgctttgtttattataaggatgcgggtgcactcttagaacgggcggtttacagctttatgctagatctgcacacacaaaagcaagggtaccatgaaattattccgccatacttggtgaacgctcagacaatgtatggaactgggcaatttccgaagttcaaagaagacgtctacacggttgaatcttcaggaatgacgttgatcccgacggctgaagtaccgctgaccaattactatgcgaatgaaatcttatctgaagatcaattgccaacgtacttcacggcgatgacgccttgttatcgctccgaagctgggagtgcggggcgtgatacccggggcttgattcgtatgcaccaatttcacaaagtcgagatggtcaagtactgtaaacctgagaattcatacgatgagctcgaaaaattaacggataatgccgaagaagtgttgcgcgaattagggcttgcataccatgttattaagctttcaacgggggatactggtttctcatcagccaagacctatgatgtggaagtatggatgccagaacaaggcgtttatcgggaaatcagttcatgctctaactgcttggacttccaagcacggcgggcgatgattcgttaccggaaagctgatgggacggtcgattacgtccacacgttgaatggttctggacttgctgttggccggacggtagctgcgattttggaaaattatcaacaagccgatggcacggttaagattcctaaggtgctccaaccttacatgcatggtatgacagagataaaataaaattattatgagaataaattattattcaaataattcatttgaatgttaaacttaatatcactaggattgagatggatacaggctaggactgttatgataatctcagtcctttttaatttggtgttaaaaatacttgatttttataatcgaaatcacatgaacggtaattgccaccgtgataatattttatcatgaagaaaaggctttcacggcgctaaagtgatgtttatcacaaagtggcgttttacaacgagtcgagacgttaaatctaatgggagggttattcatgcaggttatgttagcacattctctggtgtgaccagaacaacgttataaaaaggagatttaaaaatgacaaatatatttaagggttggagaaaaaatgatactttttggatgctgagtttgttcggaacggcgattggggccggcgtgctattcttaccgattggagttggcacggcaggtattcttggtatcatcatgatacttattttggctttgccaaccacattttttgctcacaggggcctgagtaggtttgtcttgtcggctaaaaatgatggtgatgacattactgatgttgttgaacaacattttggctttaagattggattgctttttaccattatttatttcttctccatttatccaatcttattagtttattctgtttctattacgaatactgtatcgaaatttattaccgaccaaatgcacatgcaaacaccacctcgttggctgttgtcgctagtgcttgttgggatcctcgttggaattgctcgctttggtacctctttgattaccaaagttatgagtggcctggcctttccatttattattgtaatcgttctgttttccttttatcttattccacattggaacggcgcaatcctctcaacattttccagttccgtatctgggggacatttggttggcactttaggaaacttgtggttacttattcctgttatgatcttttcgtttaaccattctccgattatctcttcattttccgttgccgaacgtaaagaatatagtggagaaggtaaggacaaagtcgataaaaagatttcgacaattctattgtcggccgaaacgttgatggtcattgtcgcaatgttctttgttattagttgtacattggcgttgactccagatcaaatccttgaagctaaaaatgaaaatgtttcaatccttgattacgttgcgactgctttcaataatccaattattaaatatgtttctcccgtaattgcctttattgcaattgctaagtcctttttaggacattatctaggaacgagtgaaggcttacgtgggattattcgtaagatggaagaaaaatctaacaagacgctttcaagtcgaactgtttcgacaattgttgatcttgttctgctactaagtgcctggatagttgcctgggtcaatccttccattatgggaatgattgaaaccatcattggaccaatcattgcgtttatcttgttcttgatgccaatgtatgccattcataaaagtcctaagttacagcaatatgccggcaaacacagcaatgtctttgttgtggtaattggattaatcgcagttagtggtatcctgttcaatatcatcaaattgtttatttagtaatctgactaaaatacgagatgaattcacattggttaatattattgaagccaatttttgtcataaatctcgttgctagtgctattgacgagattcgcatgacggtgttggggttcgtgagggtcgcgaatcgaatgaccatactggaggctggattaatcacaacggcggagttaattcagaaatgaaagctttgatgcaacggctttatgttttctcatcagtacaactgtggtgcttgcttgtaccgtaacttcaagattcataaagtttcgaaacgatgtactgacgatgaatgcgcaaagaagcgctagttgcccgtgccaaagcttaatttaacgtgatgattcaaataggaggatgactaaaatgacggtgaattacaagagtgtttttgatattattggcccgattatgattggaccttccagttcccatactgcgggggcgtgtgcgattggtcgagcagcgaatagcatttttcaggagaaaccgacagatattgtcattcattactatgaatcatttgcgcaaacccacaagggccacggaacggactatgcgattatcagtggcattcttggttttgatcctgatgatagccgggttccatatgccattggtttggcccgagatcaggggataaatattacctttatcgaagagcctggtgatagcccaatcaaccacccgaacactgccatcattgacttaaaaaatgatgataagcaagtgacggtcgctggatgttcaatcgggggtggaaccatcgaaattcgtgaaatcaagatggatggttttgatgttaaacccaaagggccacttcctatcttgttagttcaaggtggtgagaatgaccatcagcacgtgaccaaacagttggctgatctgactaaagtaaacgaccagcagcagtacaagacggctcggggcaatttatatgaatatgatttggatcgccgcctcaaacaggatgaaatcaaaaaattagcgcagggacacgcaaatttagtttacttataatcagggaggtcagttatgatgtacatgagcgtagcagaactggtaacagcggccaaggagaccaagaagccgatctacgaattaatgattgaacaagagatggaaacatcgcaaacgagtcgcgaagaaatctggcacacgatgggccggaatctagacgtcatggaagcagctgttaataaaggggctgcaggcgacggggtctattcaacaactggtttaactggtggtgaagctgttctcttgaaaaagtatcgtcaaaaagggcacactttatccggcgatacgatgatgcaagctgttcagaacgcaatctcaaccaatgaagttaatgcttcgatgggagtcgtttgtgcgacaccaacggctggatcgacggggacactacctggtgtgattttcacgctgaaggaccgaatgaacctcaaccgtgaccagatgatccaatttctatttaccgctggcgcttttgggatggtcatagctaataatgctgggattgctggtgcgactggcggttgccaagctgaagttggtagcgcttctgcgatgggcgctgcggccgcggttgaagttgctggtgggacgcctgaacaaagtgctgaggctttggcgatggcaatcagtaacttgatgggattagtgtgtgatcccgttgctgggttagttgaactaccgtgtgttaaacggaatgcgattggggtcggtaatgcgttgattgcggctgacatggctttggctggctgcacgaacaagattccagcggatgaagtcattgcagcgatggataaagtcggtaagggcttgccaaaggcacttcgggaaactggactgggtggcttagcggcgacgccaaccggtattcggatgaaggaaaagatttttggacgatcgactaattcacaagttcatgcataaaaatgtcgcagaaagatgatgagctgactaaaggcggtatcatcttttttaattagatgtttatatcgttacatgtattaacattttatcagtgtgataaaataatattaagtcataacgttgtaaaaaaatagtgaggtgagtgccgttatgcaaaaaccattaacagctgagcaagaatacgtgcgcgagtttattccgtttgttgattttttagcagatatcttaggccccagtagtgaagttgtcctgaacgacttgttggatttaaaccactccgttgtggcaattcgtaattcccacatatcacatcgacaagttggcgatcctgcaactgacttagcgttgcgaacgatgaaggccggtaaagctgaaaagcgtgattatctagccaactacaagggtgtttcgcaaggaaagcactcactacgatcatcaacttattttttgcgattagatggtgaaatcgtcgggatgatttgtattaatacggatgatagtgccctagacgatctgcaggaacaagtattgaaggtaatggcgagttacaaacatttgaactcaccaacgattaatcaactcaaaggaacaccagctaacgagaaggcccatgacacgccggtcgcgccggaacatctaaccacttctatcactgatttagctcgggaagtgacccaggctgtctgtgctaagtatggcgtctctgttgaatatttaaagcaaaatgaaaaattagaaatcgttcgtagcttataccaccaaggttacttcctattgaaggattcagttagtgaagccgccaaagtgctcaaagtctctgatccgagtgtttatcgttatttgcagaccgtcaaagatgaggatctccagcaggattaaacgatgtaattgtaagcgattaacgtcatgaaaccctgtcaaaatttagttcagccatagtggcgaaactgtgaggaagctactctgagttcccggacaggtaagaatcatggtcaccaccgtaaaaatgcggcagccaacacaaccagtttgtgtgcgggctgccgcattttaagtagttaaataaactgagcaatcaaatcccccgttgttcagtggtggctggtcgcaattggtgtggcgattagtgccagaggagcgcgtgtttttatgtgattcaggttggaacgtagcccctttttatgataatttggttagaatgacatctttgaggatgtcagtgggaattttctaggtcttatcaaaagggaaattaaagattttattaatttggttatcaactgattatcatcataataaatctcatgcaattttcattagctgacagcgagttgaaaggctgatgtagcgggggtcaattgcgattattatcaattatcaaagattatcaaatcgtatcatggaccgttgattggcgcattatatggtattatggtgaataataaatggaggtgatgccaatgttgacaccgaacgaaattcgacgccggttacgacgcgatttggttacaattgccgaagcttatcagattggctttgagagccgtttatacacggaagccgagtatgaaaacttaaagcagacgttattgcagttgcgtgaacttaatatgaaaccccaacatatggaacagctacttgcgattaacgggtaacggaaggttattaattaaataaggaagtgattagtcatgaatactgatagtccatcaggttcaattcagtccagagagtgctaatgccagtgaaatttatcacgcgcattagcacttttctatttttctatcgggcattgtgctaatagtcgttctgggcggggcatgattaaagtggaacgtttaattgaattattattcggcatcatcgcgctcccaagcatcgtatggggtacatagtatgacagcagcaaaattagtgaggaatagtgacaataatcatgtgaccatgttaactgttaatatcagaataaactgtgtgatatcggcgactttgacggcaccttaaattgtgcagatttagcttaattatcttaccaaatcattcatgaaagcgtttgaattagtcgagttgatgattttattgcgtaaaaaggttacagtttcctgatattggttgtatttttgacagacattctttattatggttaatgattgtatgatacagtgtgacacttatttagcgaggaaagttatgttatgaaaaaaatgataatccatggcggaaaacgactttctggggaattaacgatcggtggcgcaaaaaatagtaccgtcgcactgattcctgctgcgattcttgcagacactccggtccaattcgatacggttccgcacatcttagacgttcacaacttacggctcatcttagagtcgatgaacgtccattccacttttgaaaacgatgttctaacaattgatccaacaaatattgaagaatctgaattaccaagtcatgccattaaaagcttgcgggcttcttactactttatgggggccttactcggtcgttttaaccgtgcaacggtgactttccctggtggtgataatattggtccgcggccaattgatcagcatatcaagggttttaaggcgctcggcgctaacgtcgttgaagagaatgactctgtctttatctcaacgggcacagagggccttcacggagcgcgtatctttttagacgtggtttccgttggggcgacaatcaatattattttggctgccgtcaaagctcatggtacgaccacgattgaaaatgcggctaaagagcctgaaattattgatttagcgacttttttgaataatatgggcgctaaaattcggggtgctggtaccgacgtgattcgaatcgaaggcgttccggcactgcattcgcgggcaacccatacgattattcctgatcggattgagacgggaacgtatctatccctggctgcttcgattggggacggtattttgttaaagaatgtgatccctgaacatatggagtcattcacggcaaaactagtcgaaatgggtgtcgatttacagattaatgaagatagtatttacgtcccacggtccaatgatttggacccaattcgggttaaaacaatgacttacccaggctttgccactgatttgcaacaaccaatcaccccattattattgcgcgctaacggtagtagcgtggtgattgatacgatttatccgcaacgcacgcaacacgttgaacagttacgtaagatgggggcggacattcgcgttcaagataacttgattgtcgtgggtcattcttcccacttacaaggtgcgcatgtcgaggccggcgagattcggtctggggcggcactaatgattgctggtctcgcggctagtggcgttacggaaattagtcgcgctgacaatattctacgtggctatgatcgggtcatcgataaattgcatacacttggtgcggatgtggaaattgcagccgacgaagaagttcccgaaaactaacgatgtacagctaagaaagaacagtggttatggaaaaaattttaacaatgcacgatctcgagcagaaaacgttaaaagaaatttataactatgctcgtgagtataaaatttcttattattcgcaaatgaataaaaaggaactctcattagccgttctccgtgagcaggataaaaagcggggctttgtacaaatggaaggcgtcttggaaattattagccaagagggctatggctttttgcggccaattaattatgggccttcgcaggaagatatttatatttctcagtcgcagattcatcgctttggtcttcgtaacggagactatgtggctggtcaagcccggccaccgcgacctaacgaacggtattacggtttaatgcgggtagggacggttaatggtaaggatcctaatgaggccaagcaacggccccattttccagcgttaacaccactttatccacaaagacaaattaagttatcgacaacggccgccgttttagcaacccgtttgattgatacttttgtcccgattggcttcggtcaacggggcttaattgtcgcacctcctaaagccggtaagacgacgctgttaaagaatattgcaaatggcatcgtcgccaattatccagacgctaagctgattatgttgctgattgatgaacggcccgaagaagtgactgatttagagcggtcaatcaagggagaagtggtgagttctacttttgatcaacaaccacaaaatcacgtgcgtgttgcggaattggtgcttgaacgtgcgcggcgcttagttgaagacaaacaggatgtgattatcttattggattcgattacccggcttacgcgggcatataatttggttatcccgtctagcgggcggacgttgtctggtggggtcgatcccacggcgttttacaagcccaagcgattcttcggttccgcgcgcaatatcgaggaaggtggtagcctaacgattttaggcaccgcgttagtcgatacgggtagccggatggacgacatgatttatgaagaattcaaaggaactggcaactcagaattacagctatcccgcgagttagctgaacggcgggtcttcccggcgctagacttgaagcaatccagtacgcgtaaagaggaattgttggttagtcgtaagaatttggagccagtctggcagattcggcgatcaatgactggcaacgcgttagagtacaccgaacagcttttacaatttttaaaacacacgaagaccaacactgagtttgttcgtgatctagctagcttaaagttcactggtcaatcaacccggcggtcgcgtcgttaatactggcaggcaggctactttgtaggttgacgggaagctgtgattcgtgataacatgtttatcgttggttaaaactatgataatctctgtttcagcaaatgattcagggcaaaggagcgaaatacaatgcaaaaaggaattcatccagattaccatttagttgtgttccaagactcaactactggttttaagtttatctctggttcaacagcaacttcagcagaaactgttgaatgggaagatggtaatacttacccattgatccgtgttgaaattacgtcagattcacatccattctacactggtaagcaaaagtttaccaaggccgatggtgcggtcgatcgtttcaacaagaaatacggtctcaaataagcagacaattaaacggcgttccggcttcggctggggcgtcttttttgtatgtgcaaatcatcgacactcacaaacaaagccgcaccagttcgagtaatgaactgatgcggctttgtctcacttacgatatgattagtagcgcataatcgcgagagcagcggtttctacgggcatccggtctgcggggatgattcggatttgcccgttcatggcaatcacgacatcgaccaggtcgtcaattaaattatcaggagcagcaattggatcatttaattgaacatcggccgctggtaaggagccggcaacattcgcgtctgcggcgacaatcaaggtgtcgatccgcccacttagtgctggcttgatcatgtcaaaaggatcggccaatgctaactggcgggacttagcctgatcataacgttctagtaaaatgtcggctaattgggtatgccacatcgtctgaacgggttctgtggctgtttgcattgcgcccaccgttaagtttttcggtgacttattgatcatgaggtgttgtgacaagtacggattcttgttgacggcacggaagactgcctggttatgtggtagtcccattaagatcaatggccgtcgcgtcttttgtgaatgggcctgaacgtactgcgccacttgttggtaataatttcgttggtcaatatcgcgttcttcggccttcgcattatgaccatgatagttggcaccgtgaacggggctggcgttgaaattcaggtcaccgccacgtttttcagtgcccaatgcttctgtcagggtgcggggggcctcagctggcaaatcaagttcgacgaaactgccatcacgttgggcgtagagcgccatgctatcttcattgagtgctagcaagtcgaagtcgaattgatgctggcggtcggctagtactgggcgaatagctggcatgctattgacgctgacatggttgtcagtgggatattgtaagtcgaaaatgtgtaggtcacgactgttagtgatgatgcctgtctgagggccagtgtgctgtaaccagaaggcgttgtcattaattaattgctctagttgcgtcgcgtatggcgcaaattcggttttcggaaagtggtgggccatctgggtttcagcttcattaactaattgtttgaattgtaagcggcggcgattgaggtcgttgagcacaacggccgtgttgaggtaaattgcaatgtatgggccatcctcacgttgttgcattagttgattgagatcgttttttaccatcgtttccataggtccaacctgctttctgtttttgatacaattagcataacaagaatctgattacggacgcaaatataatgattatgataagctatagataattctaacgaactaaacgaattcggggctttattatgcgaactaattaaggtatatttaccgtagaacctttgataaagggcgtaaacaaattaggaggcgggattaatgaagtccaagcaacatcccgggttaaagtggttaggtcggggcgtttttgtcctgctggtgctagtatcattggcattaattttcaatgaacagatcaagagctggttagtgagttcatactcgccgaccgttacggctaagacggttaagcagaatacgaagaagaagagcgattttaacttctcaaaggtcaagtcacttgactttcagaccgttgccaaggcccgcatgaataagaatgcaatcaacgtgattggctcgattgcgattccgtccgttgatttgtacctgccaatcggtaatggtgtcagcaatgaaacgttagcattggcggctggcacgatgaaagctaatcagaagatggggcagggtaactacgcgttggctggtcaccatatgatcaagcatggtgcactattcagtccgttgtactataagagcaaggttggccaaatgatttatgtgagtgatgccaaaaagatttatgcgtataagacgagtcagcgaacattcattaaagcaactgatgtccaagtaattgatgatgttcctggtcagaagctgattaccctaattacctgtgataagaccggggcgggtcgcttaatgattcgcggtaagtacgaacagcaatggtcgtttaagtcggcgccaactcaggttcagaaggcctttacaagtcattttaataacaaatattaacaattattacattctaggggtatcgatatcttctaacggaatttcacggtacaatataacttaaggtcacatgtctcagataagacataatttagagggggtctattgatgatagctttaattatcgttgcggtcgtattggttttgatcgcaatttacgtggtaatttataacggtttagttaagtcacggatgtatacgcaggaagcatggagccaaatcgatgttcagctaaaacggcggactgatttgattcctaatctggtcaatacggtcaaaggttacgcgaaacatgaaaagagtaccttagcggaagtgatttcattacggaatcaattaacgcaagtgccgagcggtgatcaccaacaggctatggcagtttctgatcaattgacaaattcgttgaagagcatttttgcgttagctgaaagctaccctgatttgaaggctaatcaagaattcggtaagctgatggaagagttgaccaatacagaaaacaagattgcttattcacggcaactgttcaactctagcgctgccagctataacatgaagttacaacaattcccgtcaaatattattgctggcattcatcacttcaagaacgttgaattcttaactgttcctgaagcagaaaaagcagcacccacggtttcatttgaagattagaggttatgcccatgttatttgagcaaattgcccgcaacaagcggcacacgttatacgtgatggccgcttttgtcatattacttgcagtgattggtttagcagttggctacgtgttttttaatagtgcgattgcagggttactagtagccttgattgcagcggtattttatatggtattaatgattagtcagtcgaccgacattgtcatgagcatgaatcatggacgtgagctgcatcaagctgacgatgatcccgagctctggcacattgtggaagacatggcgttggttgctaaagtaccgatgccacgcgtctttattattgatgatgagagccccaatgcgtttgcgacaggaaatgaccctgagcatgcggcagttgcagtgacaactggtattcaggcacgattaacgcgtgaagagatggaaggcgtcattggtcacgagatgagtcatgtgcgtaactatgatattcggttacagaccattgccttggctctgacagcggccatcagtttgttagtcaattggggtatgaacgccttttggtggggcggtggccggcgcagtcgggataatgatcgtgacggcaacggtgcccaggtcttactaatgatcctagcgattgttgtcattattttagcgccgctagcagctagtttagtgcagatggcgctatcccgtaatcgcgaatacttagcggatgctggcagtgtggaactgactcgtaatccgttgggcttaatcagtgcacttgaaaaaatcgatgacagccaacccatgcaagcggcggatcctagtagcgcggccctctatatttctgatccgtttaaggcgaagagatcatggacgcacttattcgatacccacccaccgatggctgatcgcatcactcgtttaaaaaacatgtaataaaaaaatgcgtttaggttaataacggattataatgaaaacaaatagaaagttgaaagagtgagacggttgcaacgcaaatatatttacgccaatttggaaaaactggataaccttgtctttgcttacgggatcgaccagagcgactttgtgcatggtatcaagcgcttgccagctaacttggtctcgttagtcggtgttgatgataacgagcatgcggtaaatgctcacacgggtctgaacgtcattaatgatgaaaatgaaattcggcgatatttgttacagagtcacgcgttacccgttaagtggcttgattatgatgaagttggcgatttggattttctaaccgcgactgagattgccgagctattgtatctcggacatatggatcgtccaattcgatcaccgtttaattacaaactgcgcaaccactacgttttcttggaacaacgcaatggtggtatcaaagtgtacttctattatatttccgcatttagccatattttaagtgctgccattgtgcggcacactttggcagcttaccgtggccggcgtatgtttatgcgttcactgagcgttccacgagtacctgaggcgattctcaagcaactcgttcaattgatgccagatggtttgttcatttactttgatcagtcaatggttcggcaacgccaattattggtgccggtgcacacggagacgacaggcaatgaaatcgaagtttttgatcccgctcgtggtggagagaatcggcgaacccaccatgtcgcgacccttacttttaacttgaattcaggcgtgtgggacttgcaagtgcaggaccaggctgcgttcgaagaacatttatagtattatcatcttaacgcttggctgatcattcagcgggcgtttttaagtcgtttggggcgggatttaggggctaaattggtctagccatagagtccctggggtcaaagtggtataatttttatgcgcgtagcttgaattgggctacgattcgagaaagtggaaccttagtcagaacttggctgaccgacaagtggtcgccatgaatggagagtttaatcgatatgaagatgcaagttgccgaaattgctaaggccgttcaagcggtcaatgccgaacaggcgtggcccgatgttaatgtaacgggtgtggcgtttgatagccgaaagctccaagcaggggatctatttattccgctgatgggcgctaatgatggtcatcaatatattcaaagtgcaatcgagcacggggccgttgctaccttatgggccagcgaccatgccgacgacgttccagaagacttacctgtcattatggttgctgatacattgacggcactacagcagctggggcaatactatttacaaaaaattaatccgaaagtcgtggctgttacgggtagtaatggtaaaacaacgacgaaggatatgattgcgagtgttttgagcactcagtttaacgtgacaaagacgcacgccaactttaataatcagattggtgtgccagtgacgttactcagtatggaaccgaatacagaagtggtcgtcgttgaaatggggatggaccattttggcgagttggatttcttgagccgtctcgttcaaccagacgttgcggtgattaccatgattggggaagcccacattgagttctttggtacacgggatcgaattgctgatgccaaaatggaaattgtccacggcttaaaagaagatggtacgttcatttttaatggtgatgaaccactgctacaagaacgtgctaaggaagtcagtcagcatcaacggacgtttgggttggatgatacgaacaccttagcaggcagtgatatcacgactagtcgggctcaaacgcaatttaagacgagtctgtggccggacaacacgtacacaattccgatgatgggtgcgtacaatgtcaataatgcattggcgtctctcttggtagctgatacttttcacattcgaccagccgctgcacaacaagcaatcgccagttttgtgccgacggagaaccggacggaatggttaactggttaccgtggagaagccatcttaagtgatgtttataactctaatccaacggcagctcgacgggtcctagccgcttttgcggcggtacctactaagggtcagcgaatcgctgtactcggtgatatgcttgagttgggtgaccagtcggatgcactacacatgagtttagccagtgaattggatccagccacgattgccagcgtctatttgaatggtgaacatatgcgagcgttggcagaagtgctacaagaaaagtacccagctggtgcggtccactattatcaaacggatcaacagccccaattgattgccgacttaacggcgacggttagtgcgaatgatcaggtcttattgaaggggagtcacgggattcaccttgaaaaggttctgacggcgctggaagctgctcctgaaaaataaaatttaagtgattcgattaagcaggcccctcgcaatgactgggtaatggtgacgctaacattagactgataatgttgtttcccttccggtattgctaggggctttgcttgcttatttagaataaccggtgtatgataattcagttgtaccatatgaaagtcagaccgttggcttacatgacagcgtcttacgggaaacggattttttcctagctggcagtaatcccatggtgtcatccttaggaggaaacatatttgaagtttacagaactaggcttatccgatagcctacttaaagcagttaatcgggccggatacgaagaagcgaccccgattcaagccgaaaccattccaatggttctagaaggcaaagatgtgattggtcaagcacaaaccggtactgggaagaccgccgcgtttgcattaccaatcttacaacgcttggattttgataaccataacattcaagcattagttgtttcaccaacgcgtgaattagcaatccaaactcaggaagaaatcttccgcttaggtaaagacgaacgggcgaaagtccaagtcgtttacggtggtgctgatattcggcgccaaatcagaaatctgaagcaaaacccacaagtaatcgtcggaactcctggccggttgcttgaccacattcgtcggggcacggtcaagttagaccacgtcaagatgttagttcttgatgaagctgacgaaatgttaaacatgggtttcttggaagatatcgaatcaattatcaaacaagtgccggatgaacgccaaactatgttgttctccgcaacgatgccacctgaaatcaaacgcattggtgtgcagttcatgaaggaaccgcatcacgttaagatcaaatcaaaagaaatgactgctgatacggtcgatcaatattacgttaaagccaaagaatttgaaaagttcgatattatgacccggttgtttgatgttcaggcacctgaactcacaatcgtgtttggtcgaacgaaacgtcgagttgacgaattatcaaagggtctcgaagcacgtggttataatgccgctgggattcatggtgatttgagccaacaacgtcggacgcaaatcatgcgtcaattcaaggctggtaaattggatattttggttgcaaccgatgtggctgctcggggacttgatgtttctggtgtgacccacgtttacaattacgatattccacaggatccggacagttatgttcaccggattggccgtactggccgtgccggacacaagggtgtttcattaacttttgtaacaccaaacgaaatggaatatttgcgggtcatcgaaaagttgaccaagaagcggatgttaccattgaagccaccaactgaatctgaagcttttgctggccaattagctgctgcagaagcgaatgttgattcgttagttgctaagacttcgactgaaaagtatgctgatcaagctgctgaattattacaaaaatacgatgctactgatctagttgctgccttgttaaatgacttaactaaggacgacgcctcagccgtacccgttaagattacgccagaacgcccattacctcgtcacaaaggtggcggcggtaacaaccggcgtggcggatatcgtggcggtaatcgcaaccgcaataacagtcatggcaatggtcgtggcggttattctcacaatggtcgcaatcgcgaccgtgatcgtaacggtggccgtggcgatcggaagagcaatggttataaaggtcgcagtcgcgatgataaccggagcagcaaccgcaaccatgatgaaggtcgcaagcaaagcagcaagcggagctatacgatccgcaccaatgattaaagtcaacgcacaaattaagttgaattaaattaactttgcacaaaagccgagcgcatgctcggctttttttatgccctacaatgttagaatacaagtagtcggcagatgttcgtatgaattattgttaaaacgttccaatttaattggtttgttgttcgtcagcacttgtgcgtcctatgccgaattccggggctgggtgccaattgctggaacgcagccgacnnnnnnnnnncaattggccgaaatgcctggaggtcggtgttaggacgcgctaacaaaacatgtttacactcactcgacttttttccagcggtctaagctggccgactttgacttgacgcgtttggaacgttttaacaataattcatgctgacatgaaaagattgcgtgtatgggcccttttatcgcggcggtagctgtggtaaattggaaacatcagcctaagttgacgtgataataatgagatagagggggtcacagcgtgatttatggtaccggcattgatttaactgagcttagtcggattgaagcgattctagcgaagggactgagattgcctgaaaagatcttaacaccggctgagttggcggtgttttcacgttacccggttaaacgccagatcgagtttatggcagggcgtttttcagctaaggaagcatatagtaaggcatatggcacgggaattggtgcggcagttggatttcaagatatcgaaattttagacaacgcccagggtaaaccggaagttacgcgccacccgtttgatggtccagcgtggatttcaatttcacacacggatacgttagtaatgacacaagttatattggaaagaggcaatttgtgatggttgtaattggggagcaccgccacacacaagtcacagtcgacttgcaggcaattaagacaaatattagtaatgaaatggcgcaaaaggatgagttgaccgagttatgggcagtcgttaaagcgaatggttatggacatggaattatccaagttgctcaggctgccaaagaagccggggcgaccggcttttgtgttgcaatcctggatgaggcattagcgttgcgggccgctggctttgcggaacccatcctagtacttggaattacggaaccggaatacgccccgctggtagctgaaaaggatatttcactagctgttggaacgcaagattggctgactacggccgcagcaattttagcggctaatcaagtgacgacaccacttcacgttcatcttgcattagatacgggtatgggacgaatcgggtttcagacgcccgaaaaattggcaacggcggttacgactttgcgtcaaccgcagtcaccatttgactttgaagggatttttacgcattttgcaacggctgaccaggcagatgatacgtattttgcccatcaattaaataattggaaacacttgattgcagtggtggatgagctaccacgctatgtccacgtgtccaattcggccaccagtctctggcatcaagcttgcaatggcaacatggtgcgctttggggttgcactctatggtctaaatccttctggtcgcgaactcagcgcaccataccccttgcaacctgcgttgtcgctaacggcacgcttgacgtttgttaaacgcttcgctcggggcaaatcggtcagctatggtgccacgtatacggccgcacaggatgaatggattggcacggtgccgattgggtatgcggacggctatgaacgccgattacaaggcttccatgtacttgttgatggtgagttttgcggaatcgtcggacgggtctgcatggaccagctgatggttcgtctgccacatgaagtaccggttggagctaaggtaactttggttggcacggacggtgctcgtaccatttcgttgcaagatattgctgactattgtgggacaattcattatgagattgcttgtgggttagcaccacgagtgccgagagtttatatagattaagctttatcagacgataggtttgcgccgactgtctcgtacaggctatggttacatggttggttattgagattaagccaataaaatgagtgctggagaaattctggcgctcattttttagagtctcctattttattgatgagggctgttaagtttatttcagtgattcgattgatttatcggcatctaattataagttcgtttatttttaaacattgatgaaatcatcactgggcagtcttaattaatcggtctgaagtattagttttaacggtgcttagcgattagttctttggattaaattggtaaacggttgctaaaagtgaatggttcatgctattatgagtagcaagatggttatattgggatactatcagatacattgggtatcgaataaagggagatgaggcgatggccgcagctgacattaagcgtggtgacatcttttatgcagatttatcaccagtcgtaggctccgaacaaggaggcatgcgtccagtactaatcgtgcaaaataatgtcggtaaccattacagtcccacagtgattgtcgcggcaatcactgctaaggttcaaaaagcgaagatgccaacacatgttaacatcaacgctgcccatacggggattgaaaaaaattcggttgtgttgttggagcagatacgaacgattgataagcaacggcttaaagatcgcgtcactcatttggatgatcagacgatgcgccgagttgataatgcgttacagattagtattgggttagctgatcgaacacgacgtcggccacaacgcacgtttcaatcatagtcaatcgatggggattaattatttacataattgaactatttcggtgcgatgaccgagtatggataatcagcgggtttcaattcagttaatgactggattgaaacccgcttttagtttctaaattggctaccggtaaatgttacagggcctgttggagcatttagtgatgagctaacattattgtgcattatgattgtctttctgacgacgattaggtaagctagttgaacccattataacgaggggcgattggctgtaaatcgtgaatatcggtgaaaggatgggggcataatgagtaaacaggctcagttcaataagcatcgggtggcaggattgttagtcgcgatgggcgttgtatatggtgatattggaaccagtccgttatacgtgatgaaggccatcattaccggtcaaggtgggatgcaggccgttgatgagaagtttatgttgggggccgtctcgctagttttttggacaatgacgttgctcacgaccgttaagtacgttctgattgcgttaaacgcggataatcatggcgaaggcggtatcttttcactattcgcattggtgcgtcatcatgcgcgctggttagtcattccggccatgattggtggggctgcattactggcggatggggcgctaactcccgcagtgacagttacgactgccatcgaaggcttacgcgatgtaccagcatatgttcaactgtttggtgccggccaaaatacgattatactgattacacttggaattatcaccctattatttatgctgcaacgttttggaacgaacacgattggcaagttatttggccccatcatgttgggctggttcacgtttttgggagtcagtggcttcgttaatctggtgcaggattggacaatcctgcgtgcactgaatccctattatgcgtggttactcttgatcagcccggcgaacaaagtgggaatcttgattctagggagcgtctttctggcaacgaccggtgctgaggccctatacagtgacctggggcacgtcggcaaaacgaatattcggttgagctggccgtatgtcaaagcttgcctactactcagctatttcggtcaggccgcatggattttaggtcccggccaagcgattcagggccatgtgaatcccttttttgcaatgttacctgctaacctgacgatggcggcagtgatttttgcgacgctcgcggccattatcgcgtcacagtcgctgatcagtgggtcgtttacgttagttagtgaagcgattcgactgaaactattcccccgattactgactacttaccccggtaaagcagtgggccaaatgtatttaccggtcgttaactgggggctgtggggcgtgacgagtatgctggtgattttctttcaaactagtgaaagaatggaagctgcatacgggttagccatcacactgacaatgctgatgacgaccactttgatctacgcgtttttacggcaaaagcgcttaccattaatcggtgcgggactactgaccggtttcttcgcgaccatcgaagtgattttcctgattgccagcgcagccaagttctggcacggcggctacgtagcggtcggacttgctttactaattttcctagtgatggccgtgtggtatcgtggcgaacaaattgtccgacaacataaccacccgcttagtttacgacaatatcaggaccagcttgctaagttacgcgacgatcagacggtggacaagttccagacgaacgtcgtcttcctaacaagccgaatggatggcgaccaagtggagcgaaaggtattatattcgattttagacaagtggccgaaacgtgccgacgtctactggtttgttaatgtgacaatcacggatgaaccgtataccgcggagtatactgtcgacacgttagcaacggactatttggtaactgttaagttatacctgggctttcgtgtccgccaagatattaaccgctatttacggacgattgtccgcgacttaatggctacgggacgtttagcggcgcaaaagcagacatattcagtcacttctggccgcgatgtcggtgacttccgcttcgttatcatcgaggagaagttagaaaatggtagtcggttatcccgcttggatcgattagtgatcgagacgaaattaatgattaaaaaatacgcgacaacgcctgccaaatggttcggcctagaattctccgaggtgactcttgaaaccgttccaattctattcaacgagatcccggcgttaccgatcactgaaagacagtaatgccatgcagatttctgggggtcagaatcagccagcttagatttgcttgaaaaagttcagcgtagtgtaaacacgctctacgacatctaattgtaaggcgcttcacgtcggctacgttccagcaattggcaactagccccgaaatccggaataggacgaacaagtgctgaaaaatagaaaactaactgtcggcttgcttaacaactcatctaattttaatttttgcttgagcaactgataactcaaaactaatttcaatagctgatactggacgcaaaacgttgatttgacaacgataaaagaacgactgaattcaaatcaaaaattagaaacattaaattttgtgttgacaagtgtgaacttagaactataatctaattatattctaattattcaaatgcggtgatgagataagtaaatcaatcgtgggtttttcagggagccgggtcaggtgcaagccggtattcccgcatggttgaaaatggtcttggagcattcagtgccgaatgattaagcgctgacggtggtccccgataaacggacaaaggtatctcaattcagtgagattgacgtacctgctgaggactattttgcgaaaaatagtcgaattaaaggtggtaacacgagtcatcgtccttctgtcataacgatagtggggcgattttttattatatatttttggggaggcttcgcgtatgcgaaaaaaggaaattatttttgggttattaagttttattgcactgggaacagtattagctggctgcggcagtagcagtgctagtagtaaggatacatctaaaacctataagtatggtgaagtaacgataccagctaaggacggttctatttgtaatgcgccaaattatatcgcgtatgagaaggggttctttaagaaaaatggtatcaaggccaaactagtagcgaacccgcgggatatcagtgacctagaagcgggttttgcgagtggcaaatatgacgcgcaaaatggtgattttcaatacttacctgcgattcaaaacggggcgcaaatcaaagctgttggtggaatccaccaaggctgtatcaagttgctggttccgaaaaactcaagcattaagagtgttaaggacttaaaaggcaagacgattgggattccggctcagggttcaacaccacaatacgtgacgtccattgcacttcaacatgcgggtattgatccgaagacgggagtaacgtggaaggtttacagcactgatctattggcaaaggcggctgaaaaggggcaggtcgatgcaattgggacggtcgatccgtatgcttaccaagcacaaaaggaatctgggtttaagaccattattgataataataacaatagtggcaatgctaagatggctgcaatgggaatgaaatcaaagggtgcttgctgttacttgtacgtttcgagcaagttagtcaaagagaatccagcgaaggctaaggccattgtccgttcatacaaacaagccgctgcttggatcaataaccatcctgaagagacagcaaagattgaattaaataaggggtatgtctccaagacgaagtttatcaatgtgaagaatgtgacccagatcttgaaagatgaacattttgaactaaatcttaagacaggtaaagaagatttaagttattatatcaagcaattgaagcaagcaggatatttgaagaagaatacgaataacaagcaattgttgaagcaagcttattggtatccagatttatctaagaactaagttcaaggaggtagaatagtatgcaaataacagcagtccaattgagtcgaaaaaaagttgtgcaggcagctaagacaactggccgttattggaagccctggcacttgacctggaacattgttagtttagtcgtattagcaattgcgtattttgaaaaccaattggttgtatcacaggaaaccgttaataatcagacgtatcattggtttttaggtgggtactttgcttatttattgattgttacgctgattggcgcagttacaaatggtcgaattcgccggtataatggacattttgcccagttgaacgtttcgttagttggcttgctgatcgtgcaggatcttctgaccgaaaagtttgtcgttctagaacagcctttcttcgtgagctttgcacaaatcttggaccagatgcgcgaaaatgccggcttgctctgggcttcgacgttgtcatcattagcgctttggttgattagttttgtgattgggaccattcttggaatcttacttggtttgggcatgggacgctatcgtgagtttaactactgggcattcccctacttgaaggtcatcgggattatccctgcggctgcatggatgccgctgacgatggtcatctttccgactagttacatggccgaagtcttcttgattgccttctcggtttggtttccagtggccttcatgacgattggtggcgttcaagggattagcaaggaatacttcgaatcagcaaagaccttaggatttagtgagtggcagattatccgcaaaatcgtccttcccggagcgttgccaagtatctttactggcgtttatacggcaatgggattgtcgtttacaatgctggtaatttccgagatgattggtgctaaggtcggactgggctggtttatcaactgggcaaagggtaccgggaattatacacaagtctatgcggcaattgtgattatggcgattctgttttcagtgttatttgcggtgtttaccaaagttcaagattactgcctacgttggcgcgatggtgctcactagaaaggagcttataagatgggattacttgcagttcaacatgttaatcagcggcttcaagacaatgatggtcatcagatcgacgtgctagatgatattgatttcaccgtcaatccgggtgagttcgtagcaatcattgggccgtctggttgtggtaagaccacgttactacgcctgatttctggattagaccatcccgctagcggtcagctaacgatcgataatcagcagattaagcgaccagataattctcgcggttatgttttccaacatggcagcctttttccatggtcaacaatcaaggagaatattagtgtcggcctgaaagtgacgcgtggtcggcattatgaccaccaattggtcgaccattatattgaattgatggggctaaaaggctttgaaaatgcttatccgcatcaggtttctggtgggatggcccaacgagctgccctcgcgcggtcaattatcatgaacccgcagctcctacttttggatgagccgatgggggctcttgatgcgtttacacgtgcggatattcagaatgtcatcgaacaggtttggcagcagacacagacgacgatgattttagttactcatgatatcgatgaggcagtctacttgagtgaccgaattattgtgatgacgcctcgtcctgggagaatcaaagaaattgtgacaaatccattaccacatccacggtcacgtttgagtgtcgattttgctgaatttcggcatcggattcaagataaattaaactttggcgctcatgatggacaggttactgggtgatggctaaaaaatgcttatcaagatgattggcgagataccagtcttgataagcatttttgctgtgaaaaaacaggatcgcatggtggtgagcttgatatggccatccaggggacttcgttagttggactaagtacgaagaagcaggcttattcgcttaccatcgttgtcgtactggccaatagggtcttaagcgtatcaatcgccgtaatcaatggttgtccatgattcaatgcagcgatagccacgggattatcaggttggtcattaagcgtgaaacccactgctttagtctttgcaggccaatcagtcgtgttagcgattgttgtgacggtgaggtggttagccgcgaacagttcctggaccgcgggttgcgccacagtggcaatatcggtgatgagaccatccacggtttgccaagtctctaagtgataactatcagccatggcggcatgccaagcggtcgtgaaagtcgggccgataccaagagtctcaccagttgatttcatctcaggacttaaaacgactggtgattgtggcaatttattgaaagagaagactggggcctttatagcaatttgttgtggagcgggtgtcaagagtccggggactaggccaagggttgctaaactttgaccgagaattagccgggttgccaattgtgccagtggcaagtgagtaaccttgctcatgtaaggaactgttcgacttgcccgcggattaacgtcgattacgtagacatcatcggtgacgacgaactgaatgttcatcataccgacacagtggaggtgttgtgctaatttggtggcaatggtgacgatcttatcttgaacagcagggctgaggtgctgtggtggatagactgtaatggaatcgccagaatgaacgccagcaccttcaatatgttccatgattcctggaatgaagcacgacgttccgtcggagagaacgtcaacttcacactcggttcccgccaagtattggtccattaagataggcgcaccatggccagctgccaccgctgatttaataactggcgtgagctcatgatcgttatgaacgattgccatggcccggccgccgagtacaaagcttggccgtacgagtaaggggtaaccgattgcgtgagctgcttgatgggcaccggataactcagttacggtcgttccagcggcttgggcaatctttagtagacttaaacagtccgcaaaagattgccggtcttcggtcaaatcggtagcggacacactggttcctaggacggtgactcctaatttagtgagctgatgggcaaggttgatcgcagtttggcccccaaattgaacgatgacgcccgcgggttgctccaacgcaatgattggcatcaaacgttcgattgttagtggctcgaaataaagcttatccgagatagaaaagtcggtggagaccgtctcgggattgttattgacgacgattgcatggtagccagcttgttgaatggccttgacacagtgaacggtggtgtagtcgaattcgatgccttgtccgattcgaatggggcctgatccgagtactaaaatactgtgtcctagtgggtgactctcgttagtttgtccaaaagcagtgctgtaaaaatatggtgtaacactggcaaattcaccagcacacgtatcgaccattttataaacgaatggtaaatcagcagtcatggcagcgatggtcgctaccgaagtttgggcataatgcgccatggtcgccagactcacaccgtactttttcgccgataagaggtgttgggacgtcggcacttgcttgatattccggatgagttgggcgatgtgctgtaacttactcaagaaaaatggcgtgatttgcgttagcgtcgctaattttgctaacggccaacccgcttgcagcgccgccaatagatagaagagccgctgatctgtcgggtgggtcaattggtcgatatattcagtcgtggtgacgtggtggtcaggggtcaaggacgcttgggtcttgggatcgatttcaagcgaagcaatagccttgagcgtggcttcctccaaggttgacccaatcgccatgacctcccccgtggctttcatctgtgttcccaagtgagcgtcggccgttggaaacttgtcaaacgcaaaccgggggattttggcaaccacatagtctaaagctggttcaaaggccgcgtagattgtctgcgtgactggattcttgatctcagataaatttagaccaattgcgatatcggctgcaattttggcaattggatatcccgtcgctttagaagctagcgccgatgaacgactgacccgcgggttcacttcgatgacgtagtactgacgactattcgggtcttgagcgagttgaacgttgcacccacctctaatgtcgagggcttccacaatcgtcaaagccgccgttcgtagctgctgatattcagtgtcagtcaaagtctgaacgggggcatacacgatagaatcgccagtgtgaataccgaccggatcgaagttttccatggaacagacgatgatcttggtaccctgattatcacgcatgacttcgaattcaatttctttgaagccggcgatactttgttcaatcaagcactcggtgacgggggacatggtcaacccccgctgtaacgtttgggtcaattcggcggcattattggcaatgccgccacctgaacccccgagtgtaaaggctggacgaacaatgaccggataaccgattttttcagcaaacgacaatgcactggtcacgtggtgaacagtggtacttgctggaatcggttgatggagccgcttcataagtgttttaaatgctgcccggtcttcagcttgattgatggtggctagggaagttcctagcagttggatcttcaactcattaagaacgccagcctgatctaacgccatcgctaggttcaatccggtttgtccaccaagtgtcgggagcaaagcatcagggtgggtggcccgcagaattttagtgacactggtcaaagtcagaggttctaagtagacttcgtcggcggtggccgtgtcagtcatgatggttgctgggtttgaattgatcaaaatgacatgatagccggccgctttaaggcttagacaagcctgagtaccggcatagtcgaactcagcggcttgaccgattttgattggaccagaaccgatgacagcaatcgaatgaatggcattgtttttaggcattaacaaccgcctccttttgaattgttagtaagaaatcatcgaaaaattgcccagcttcctggggccccgggtgtgcttcgggatggaattgcaccgacattacggcctggtgcggtaggcgcaagccttcaatgctgccgtcatttaattcagtgtgcgtgacgatcagcggggtgcccttgatcgatgccggatcgacggcgtaatcatgattttgcgaagtcatgataatacgaccgtcagcgcaggcttgtaccggatggtttagcccgtggtgaccaaaggaaagctggtaagtctgagcaccataggcgagcgcaatcaactgatgaccaaggcaaatgccagccagcggataacgttgtgcgagttggcgaatggtcgctaagtaagtgtgatagtcggtcggatcaccgggaccgttggataacaaaattccgtcagggtgatacgcggccacggccttgagactagctgtaggtggaaggacaacaacgtccgcgccccgggcttgcaattcagcggtgatagctgctttttcaccaaagttgagaatcgcgacgcgtggacggatggtggtcgtcgctactgggaggggggtagccgttagtacttggggtgcgaatgtggcgagttgcacttcaaaatcagtgatgggatgattgctcaagattgccatctgggctcccgtttggcgaatgtgaatcgttaggtcacgagtatcgacgccttcaatgccggctacatggtggattgtcagaaaacttgccagtgattggcgactagtatagtgatcattaaaagtggccagctcgtgaacgatgatggcttgtgcgccaatcgttggtgcctgggccacggtcggatcgataccataattaccaattaatgggtaagtgaaggcaatcatttgatttaggtaggatggatcagtcaatgtttcctgataacccgtcattcccgtattgaagacgatgcgccccgcagcctctagctggcaatccccaattgccgttccaatccactgtgtgccgtctgctaaagttaagtatttgttcatcccaatcgcaccctttctgataatttggttaaaatttcattttggttaatgggataagtaaacatcattttattgtggatgtcaattaaaaatgcatattaaatgcataaatcgctgaataaagctaaaaatatgcaattaatagaataaaaatgaatattttttcaataaagcttgcaatttaaaagcgatgagaatatagtgtgaatcatactttctgcatgaacatgcagctaatacactatttttgaatatttgaggtgattatatgcaagtcgcgctagttggcgttacggggtacagtggcatggtgttgtaccggctcttgaaacaacatcccgagatcgatcgcatccaattatacgggcacgtgggagcaactacggtggcattaaagacggtggcagccatgtaccagaaagaaacggcggttattcgaccattcgatgcgacggcaatcatgcgcgataacgcgattgtgttctttgcgacatcagcgggtatcacgcgacaattggcattaccattcatcgctgctcattttccagtcatcgatttatctggtgacttccgcttgcatgatccagagcaatatcagcggtggtaccaacgtgatccagcatcggcgaccgctttggcgcaggcgagctacggcttagctgatatgccggcgccgttgtccacctacattgcgaatcccggctgctatgcgactgctacgttattaggactagcgccacttgctcagcagcagttggtcgaaccgacttcgattgttgtggatgctaagtccggcttatctggtgctggcaaacgagcgacagctgcgagtcattacgtcgctgtgaatgataatttgagtttatacaagttgaatcaacatcaacatatccctgaaatgatgcaacagttacagcagtggtggtccgcgatttctgcgattgaatttactaccactttgattccagtaacgcgtgggattatgacgacgatttatgccaaagcgaagtcagcattgacaacgacgcaggtccgggcagcttttaccgcgacctatcatgagcagccgttcgtgcaagtgctaccaacggggatgccgacgctcaaggacgttgttgggtctaataactgtgcgttaggcgttgattataatccggtcacgaacaccatcgtggttgtgagcgtcattgacaatttgatgaaaggtgctgcggggcaggccgttcagaattttaatcgctattttgatttcgcggttacggccggattaccgacgttacctgtatttccctgataaggtgcaataagagaggaagttatgcagatgcaagttttaacgaatacgaagtttgaaacggttgcctttcagtggccggcaggtttttacagtgatggcattcatattggtcttcgtcgtcataaaaaagattttggttggctattttcaaaagtgcctgccagtgcggctggaacttatacgacgaatcagtttcaggcagcaccaactaagttaactaaacagatgatcgaccagggccaccaattacagggactgttgctgaatagtgcaatcgccaattcttgtactggcgagcaggggtggcagaatgcgctgcaagaacaagcctggttagcgaataaactaaacgtggcgccgaacttgattggcgttgcttcaactgggctgattggtgctcagttacccatggataaaatcaaaaacggcttgccgcaattgacaccaacgaagagtgacgcggtgacctacgccgtgttaacgacagaccagcatccaaaaaccgtctgtgtgcagtgtgaactcagcggccagttagttaccttgaccggttttgccaaaggttctggaatgattcatcccaagatggcaaccatgcttggttttgtcaccactgatgcccaaatagacgggccagttttacaggacatgctaagtactaacgttgatcagacattcaatcaaattactgttgacggtgacacgtctactaatgacatggtggtcacgttggcgaatggtctggcagataatccgagtttgcaagcgggtaccaccgactatgatatttttaatcaggcgttgcaccatgtcttaggccaacttgccaagcaaattgctgctgacggtgagggtgcgaccaagttagtcgaatgtaatgtggtccacgccgctacaacgtttgacggtcagcaaatcgccaaagcaattgttggctctaacctcgttaaggcggccattttcggtgaagacccgaattgggggcgaatcattagcacgattggcgccactgatgcagacatcgatgtggcgacggtcgatattgaaatgaacggcgttttacttgttcaacaaagtctggccgttgactttgatatggcagcggtgcaggcgaccttacgtgataaccagattatgatcgatgttgatttacatcacggtacagcaagtggtcaggcttggggttgtgacttgacttacaattacgtcaaaattaacgcgagctatcatacttaaacggaggtggtgaaaatgacaaaattaattgtaattaagattgggggccaggcgattagccaattgagcaccactttctttgaccaaatcgcacagtggtaccaacagcattatcagattctgatcgtacacggtggggggccaatgatcaatcgactgacgactcagcttgctttgcccgtgcataaggtgaacgggttgcgggtgacggatgcggcgaccttagtgctcaccaagttggccctgctaggagatgcgcaaccagccttacttgcaaaattaacgcaacatcacctacctgtgttggggctcaatgcggcggataatcagttactaactggtgaattgattgattatcgacagctagggtatgtcggccggctcaccgctgtcaatcaagtgcaattaatgcaattgttggctcatcatatcggtattttggcccctttagccttaaccgagacgggacaatggctcaatgtcaatgcggatatggcagcgaccgtgctagcccaacaactacatgctgaaaaattggttttgctaaccgatgtcccgggaattatacatcacggtaatgtgatgacatcactatcgccacaacaagctcagcaattgattcgaacagctgtgatcaccgcgggaatgcaacccaaagttcaagctgcaattgccgcgattcagacgggagtcaagcaggctattattacgaatgcaatcgatcaaccaggaaccgcaattattcaggaggtggccgtatgaccatgcaacacgtgtttccaacctatcaacgttttccatttgccattatggatggtcagggcgttcatctgactgataatcatggcaagacgtatttagattttacggcgggaatcggggtctgcaactttgggtatcaccaaccacaaattcaggcggccgtcacccagcagttgacgcatatctggcatacgtcgaatttatacgaaaatgaattacaagatgccgttgccggcctgttagcgaatggtgaagagcgactcgtatactttgcaaattccggaaccgaagccaatgaagctgcattaaaactcgcacggaagtacacgggtaaaaccggcatcttagcttttcagcattcatttcacggtcgaacctatggcgctatgtcgatgacgggcaatcctcatattcaggctggctatgcgccattagtgcctggcatcacgtttgcaacctataatgacgacgcggctttggacaaaatcacaccagagttggcggccgttattttagaagtcgttcaaggtgaaggcggcgtctttgcgggacaaacagcttggttacaagcggttaatgcgaaatgccaagcaacgggtgttttgttgattattgatgaggtgcagacgggaatcggtcggactggttaccggatggcctatgaaggttacggcctggaccctgatatctacacggttgccaagggcttagcgaatggcttgccagtgggggcaatggttggtcggcggcaattagccactgcctttggtccgggcagccatggctcgacgttcgccggtaatgctgttgctatggcggcagcaaaacgtgtcttgacccaattaacaccggcgctgttaacgacggttcgagcccatgccgaacttgtctggcaagccctagcgactcaagtcgaaccgataccggtagtgaaacaaatcacggggaagggcctaatgattggaatccacttagatgaacaaatcccggttaatcaagtcattacccggctacaagtagaaggtttattgacgttatcagctggcgataatacgttacgtttgttacccccaattgtgatgcaatcggccgatttattagctgggattgccttgattgcaaaggtactgacaactttgacaacggaggtcacgacgaatgaataatcaatttgaaggtcggtcattcttgaaggaaatcgactatacaccaacagaattagcttacttaattgacttcgctagtcacttgaaggcccttaaagcacaccatatcccacacccttatttacaaggaaaaaatattgcgttgctgtttgaaaaaacgtcgacacggacacgttctgcgtttactgtggcggctaatgatctgggcgcgaatccagagtttttgggtaaggacgacatccaattcgggacgaaggagtcagttgttgatacggcgaaagtactggggtccatgtatgatggtattgaatttcggggctttaaacaaagcacggtcgaagacttagcgacctatagtggtgtgccagtctggaacgggttgaccgatgagtggcacccgacgcagattttagcggatttcttaacattaaaggaacattttggtcatttaaaagggttgacgttagcgtacgttggtgatggtcgcaataatatggctaacagtttacttgtggcgggagcgatgctcggcatcaatatcgctatcggggccccggtagcgttacagccagccccagcagtggtcgcgttagcccaacagtatgcgcaggcagctgggagcacggtcgtgattacggctgatccgcaacaagccgttactcaggctgatgcgctttatacggatgtctgggtctcaatgggcgagcaggtcgactatggtgagcggatcaagcaactattgccgtttcaaattaatactgcgttgctcgcagctactggcaagtcatcgacgattgtcatgcattgcttaccagcactacacgatctaaagacgcagctgggagccaaattaggcgaacagtacggaatgacggcgtttgaaattacggatgatgtcttccagagtaagcaggcggtcgtctttgaagaggccggcaaccggatgccagcaattaaggcggtaatggcggctacattaggtaacttatttattcctaccagcattttcaattagcaagcttgcgggaactactagagcgtgctacgattatattcgctttgtttcaatcaatacgtggttcgtaaccatcccacgttaaaaaaactaggaggaattaagcgaatgacacaatcaaaaattcgaccatggattatcaacgccctagtcgctgcaatgtatgttgtactatgcctaggccccgcagcttttagcttagcatcgggcgcaattcaattccgcgtttctgaagggttgaaccacttagccgtgttcaatcgcaagtatatttggggaattgttgctggcgttattttgtttgacgcttttggtcccggtgcgagtctcctcaacgttctctttggtggcggccaatcattattagccctgctggtattgacgtggttggcccctaagttgaagacggtttggcaacggatgttactgaatatcgcgctattcaccgtttcgatgtttatgatcgcactgatgattaccatgatgagtagtggtgtcgctttctggccgacgtatctaacaactgctttatcagagttgattatcatgagtatcactgcgccaattatgtacagcttggatcgggtcttgcactttagtgaccggattcagtagggtgtaactgaatttaatattaagaacgaccggcgtagtatgtgaagatgatttttcgcatattacgccggtctcttatttattcatttaatgaaatgtggttaatttgatttttggttgattattttgaaatggtcaacgtgttttggattgttaactgctcggcagcaatgatcgtcctaattcgaactgttttcagcagtcttaagctggtcgcttttgaactgaaaattcatctcataaaaaaagccccaaggtaacctcggggcaactgtgattattcagcttgtaaatcttccacttcgatgactttaaattgtttgcgattcaagttgtcgataattcgtttgagcttttcactgtcgacattttctggcaaggtaaagagcgtccgataaccgagtgtcccgttttggacgtctaaggtcaggcagccggcgattgaagtatatttcgtgataatcttagccatggctgcaagatcaccacgttcaccaacggagacaactgttaaaacatagctaccaacattaacgttccaagattgtgagagcatgtcgagcagacgcgtatgagtgagaatgccatagaaatagccgtgttcatcgagcaccgcaatgtatggcaaatctttgatggagaagaagatgttgtagaaggcggagtcgacttgaatcgttttcgtggcatttttaagcagggtcgtcacgggaagcgacatgtcgccgccccgtgacttgtgccgatagatgtgcatcttatagatgttgccgcggaagatatgaccggtttcatctaagattggaatacagcggaagccggaatcctccaaggcttttaaggcgtcctctaaggtcgcgtccgccgtaatggtgacgaggcgttctttaggctttacgagtgtttttaatagcatagcagttggtcccccagatttattagtttgttttaataaataataccataaaacgaccgcttacacgtatcattatgacatcaaacgacggctaaaagggatgaaaaagccggcctgataacattcagaccggcttggttaaattagatttaaattagaaaacaatgactggtgttccgactggcacggcagcaaaaacttttttcatgacagaaggtggggtgttcacacaaccatgcgagccgtgcttcttgtaccaagtaccaccatattgagtttgccatgaagaatcgtgaattccttcgccagtgtcatcgaacggcatccaataagaaactggttgggaataacttgagccatcgtcattatcacctttaagggtcgcgttcttttccttattccagatgtaccaaacacccgttgttgtagcgtgtttaccgggctttccagtaacgatgtccgttgaaactttgagcttcccatcaacgtagacgtacatatgctgattttctttatcaacttcgacgtaggtgttgccgatgtcggtgcccttgttgttatatccggaaccactggtgattggtgagcgggtaaagtccttgcctttcaaaatttcagtagcaagggctttggcctctgcttcggtcttaatggtccagccataaaacccaccgctgacggatacggtcccacgcgccgtactcttgaactgacgcgtcgtatgataggtatgatacttatcattcaattgcttcatgtaagtcagaacagcgttttggtctaaactcactttgccttgcttatcgactttaatccaactgagaattaggtcgtgaggaatcgtgaatttatgaccgttgatattataggtggccttttcggtagcgtatttcgctgattttactttggccgtctttaaactagcactcgtgctggtaacggccggagtgacgtaggcgtctttaagggtgatatgactgtcaccattactaattgctttggtgacgaccgtcttaagtttagcttgatctaattcggttccttgaacttctttcttaatctcaacttggttatgttgataaactaacttggcgttttcagtttttgttcgtttggtttgattggcagtcgtggtgattttttgtagtagggttttcaaatcagtgtgattgatggttagttgtccaaccgctgagctatcatcagcctgagccgattgcaatagtgcaaggggccaacgccagtagttttgtttggtcactaatttggttaaatcttttttagtattgattgtaataccggctgatttgctggtaaatgagtactttgtttggccgttttcaataattcgataagtgcgatgttctaaagcgcgattaactttcggtgctgcttgagcggcggttttaccactgacgtcaacaccagcgaccgacgtattactgaggaacgtttgttgatgttgccagattaagctcgtggcaacatatccgatgacgaggagaccgaggatactgcccccaatcataagtccacgtttatgtttcataattaagttggtcctccatatattcgtaatattctcaccttataacagaagtgagatgagtgcaaacttcaaggccggtaatcgtgataagaaagttttaaaaatagcctttagtgcgtgttgcgctttaatgaatcgctaaggtaccctcaagcaaacaaaaaaacgcccgtctgctatagacgagcgttcatcatacatttaatcgtatgaaatgattatttattttctaattcagctaaaccgtcgttaagcacttttttcaaagttgcggcggaatcttgcatcttcttgagttcgtcagctgaaagtggtgattcgatgatttgtttcaaaccagttccaccaatcacagccggagtcccgatataaatgtcgtttaagccgtattggccgtccatgtaggcacctactggtaaaacggcattttcatcacgtaaaatggctttggaaatccgcattaaagcagtcccgataccgtagaacgtggcacccttcaagttgatgatgtcgtaagctttgttacgaacaccgtcttctaacttggctaaatcttcgtcagaaacgccttgttccttagcgacatcgcgaactggacgtgtcccgatggttgcagttgagtaagcagcaaattcagaatcaccgtgttcacccatgatgtaagcatcaacggaacgaggatcaacattgaattgtttgcctaacgcaacgcgtaaacgtgaagagtctaaggaagtccctgaaccaatgacacgatcctttgggaaacctgagaatttccaagtagcgtaagttaagatgtcaacagggttagcagcaactaagaagatgccgtcaaagccggagtcaacaactggtttgacaatggatgataggatatttaaattcttgttaactaagtctaaacgtgattcaccaggcttttggggcgcaccggctgtaataacaactaagtcagcgtccttacaatctgaatattcgcctgagtaaatcttcttgggagcggtgaatgcttgggcgtcttcaagatcaagggcgtcaccctttgtccgatctttaacaacatcgacaattacaaattcttcagcaattccttgttgtgccatggcaaaagcgtaactagaaccaacagcgccgtcgccgactaacacaactttttgatgatttggcatgcttgacaaaataagtcatcctctcgtagtgaaaatttagtttttacggttaaagtataccatgtttgtgcaaaataagtgttagattgagcatgcttttaatacaattattaacaatgtccgcaaaaccctttggcgggcgtcaataagccctttgtggtatacttatcgcacttaataaacgctaacttttgaacacttgactggcgggcgcgtcggtcacggtgtgagtagtggtgccaatacgacttaggtggtatcgttactcagagttgccgaatcgggtcgattaccggttcggcctgttttggtatgcaaagtaataggagaagataaaattatgaaaatgatcgttgggttaggcaacattgggcggcaatatgcccagacacgtcataatgttggttttatgattgtggacgaattagctagcaaactaaacgttacgtttcaaacgagtaaatttgaagcacaggtggcaacggcttttcaagacggtgagaagattttactggtgaaacccgccacttatatgaatgattctggacgagcggtgggaccgttgatgagctattacaatgttgatcctgctgatttgctcgttatacatgatgatttagatttaccactaggaaaagtacgcctcaaacaaaagggatcggcgggtggtcataatggcatcaagagcattattagtcatgttggtgatcagcacttcaagcgcgttaaagttggtattgaccatcctcagaagatgagtgttgttgattacgtgttggggaaatttacgccagccgaagtggcgaagtttgacgatgctaagattacggcgctagcggcggtcgaagcttggttagcaaatgatgattttgcggcagttatgaatcaatataactagcccgggaggaaacgacagaatggatattgaaacgattgttgagcaaacgcccgactttcaaacaattttagcaggtatcaacccgcgtagtcggcaactaatcaccggattgaacggttcggcacgaacggtttatttaagcgcgctatttcaccaattaacgcattcattactgatcgtgaccgataacggttttcacgcgagtcagctagtggatgatttaacgagtctcttagatgaagaccaagtttttttattcccagctgaagaaatgattgcgacggaggttgcgacaagttcaccagagtcacgagcgcaacgagtccaggctttaaacgccttattgcgtgacagtccggcagtggtcgtgacctcggttgcaggtgcccggcggttcttgccgcccgtcgcacaatttcaagcagccacgttaccggtagccgttggtcaagatattgatttggaagacttgcagcgacaactacacgacatgggttacgttaaggaaaagttagtcgcacgcccaggagattttgcggtacggggctcaatcgtggatatttacccgttagatgcggactaccctttacgactggacttctttgatactgaagttgatacactgaagtattttgacccggaaacgcaacgttcggtggaaaacttggatgagtatacgattttaccagctaccgactttatcctaacatcagctatgctgcaggccggggcacagcgtcttaaaacggcgattgcggctgaaaataagaaactcaagccagccgaacgccagactttggccgataatttagcacaacctttagctgacatggaaaaaggaattatcggaaacgatttattattatatggcgattatttatacgaccggaaaacgagtatttttgactatgtggccgctgacgggctcgttatcttcgaagaatattcgcgtttgcttgatagtgagcagcagttattaacgcaagaagctgactgggttacggaccaattggcacatcaccgggtgctggcaactgcgagttacggcaatgatattcgggatttgctccgggatgaccaacatgcacaactcttgatttcgctgtttcaaaagggcatcggcaacgtcaaactagcgcaagtaactaacgtgcgcacacgcccgatgcaggaattttttgggcagctcccagcgttgaagaccgaactggatcggtggcataagcttaaacagacggtggtcttgatggtatcagaggctgagcgtctgacaaaggtcagtgatacgcttgatgattttgaaatcgaagcggtcatgactaaggccactaatttacaaccgggtgcggttcaaatcgtgcaaggtagcttgcaaaatggatttgagtttccggatggtaaattagtcatcgtaaccgagcaagaaatgttcaagaaggtggctaagaagcgtccacgtcgtcagaccttggctaatgccgaacggttgaagagttatacggatctcaaacccggcgattacgtcgtgcacgtcaatcacgggatcggaaagtacgttggtatggagacgctggaagttgatggtgtccatcaagactacattacgattgcgtatcaaaataatgcgaagatctttattcccgtgacccagttaaacctagttcaaaagtacgtttcgtcagaatcaaagacgccacgcatcaataagttgggtggtaccgaatggacgaaagcgaagcgcaaagtcgcggcgaaaattgaagatatcgcggatgaactagtcgacctgtatgccaagcgagaggcggagaaaggttacgcctttccaccggacgatagttatcaagatgatttcgataacgattttccgtacccagagacgccggatcaaattcgtagtattaatgaaatcaagcatgatatggaacgaccgaaaccgatggaccgcctattggtcggcgatgttggttatgggaagacggaagtcgcgttgcgggccgcgtttaaggcgattgaggccggcaaacaagtggcctttctagtgccaacgaccattttagctcagcaacattatgaaacgatgctgaatcggtttgaaggctatccgattaacgttggcatgctgtcacgattcagaacaactaaggaaatgaaagagacggtccaacagttaaagagtggtgaaattgacatcgtggttggtacgcaccgcttactatctaaggacgtcgcgtttgctgatctgggcctgctcattattgatgaggaacaacggtttggggtcaagcacaaggaacgactgaaggccttgaaggctagtgtggatgtcttgacgttaacggcaacgccgattccgcgaacattacacatgtcgatgctcggtgtacgggacttatcagtgattgagacgccgccaacgaaccgttatccgatccaaacgtacgtcatggaacagaattttggcgtcattaaagagggaattgaacgagaaatgcaacgtaatgggcaggtcttttatttgcataaccgggttcatgatattgataaagtcgttgcacagatcaaagacttggttcccgacgcggcggtggcccatattgatggtcagatgcctgagtcacaactcgaagggattctctacgatttcattcggggtgagtacgatgtgttagtgacaacgacgatcattgagaccggggttgatattccaaacgtcaacaccttatttgtggaaaatgctgaccggatgggactgtcacagctataccagttgcgtggccggattggtcggagtagtcgggtcgcctatgcttactttacttatcagcaaaataaagttttgacagaagttggtgagaaacggttacaggccatcaaggactttacggaacttggatctggctttaaaatcgcgatgcgcgacttgtcgattcggggtgctggtaacttgttaggtaagcaacagcacggctttattgactcagttggttatgacctctatacccagatgttgtcagaagcagtggcgaagaagcgtggtcaggcggctaaagttaagaccgatgccacggtcgaacttggaatcgaagcctacttgccgaccagctatattgaagatgaacggcaaaagatcgaaatttataaacggattcgccagctggagaataatgatcagtacatggaagttcaggatgatttaatggatcgatttggtgattatccggtagaagtcgctggactattagcagtaggtaagctgaagttactggcggatgacgcgctgattgagaagattcagcgtgacgatagtgagctacacctaacgttatccaaacaagggacggctaagctagatactaaagatatttttaaggccttggcaaaaacaaaattaaaagcgacagttggaattgatgatgataaaatgaaggttaaattagtcattcagccaaagatgcaacaggatgagtggctggcgcaattaacacagtttgtcgaacaactgagtttgatcttagccgaagacgatgtcgctagtacgtcttagctcggtagttgttgttatgaagcatggttgcacggggtgggttaagcgctatcgagtggaaccaatggcaaatagcaggaattatcgtctgatggggcgttgtcctggctagtcagggcgcggctcaaatgaattagtatgagacaccgagttgctcggtagaagggatttgttatgccaaaggatcacttgaacaccgtgttcaaaggtgcgttaattttatcgatatcatcattagtcgctaagattttaagcgcggtataccggattcccttacagaacatggttggtaatacgggattttacgtttatcagcagatttatccgctgtacggcattggcatgacctttgcattaaatggatttccaaattttatttctaagttagtggcagaacagccagacgaaacgagtaagtcgctgattgcacggcgggcgtttcatatcttatccggattatcgttggtcgtctttttcggcttgcagcttggtgcaacgtggattgcggcccacatgggtgacgttaatctagcaccaatcattagtgccgtggcttggatgtttgtctttatgccatggttagcaacaggccgtggttactatcaaggaaaatttttgatgggaccgaccgcagtgtcccaactgatcgaacaggtcgtacgggtcgcaattatcatcatggctgcatatttcagtgtccgtctcggttgggataattatcggatgggaacgtgggcaatgagttcagcgccactagctgcaatctgttcatcactgatttttactgcttttggtctacgctatttattggcgcccgcacccgcacccgcacccgcaccgacccacccattacctagttatcgcaaattaaccaaaagatttgtaattgaaggtgggacgctgtgtcttgtcgccgctgtcgttatcttactgcaattagtggattcatttacggttatgcggggcttggtacatcaaggtcagttaccagaagtagccaaggcactaaaaggggtctacgatcgtggtcaacctttggttcagttagggttggtggtggcgacggccttttcagcaacgttattgcctgctttgacggatgcgttagccaagcgtcaaccgattgaattcaagcgccagacacaggcgatggttcacgttagtttagcattatcaatggcagcgacggtcggtctagttgcgttgatgccacaaatcaatcgcttgttatttggttcattagaaggaacaacggcattgcgaatctatattattagtattttatttgcagcgttgattacgacgtatacaagtgtgttacagagtttgaacgaatatacggccatgatcattggcatcattgctggattagcgacaaaagtgctggctaattacatcttcgtggtccactatggcatcaacggtgccagtgcggtgaccgtattgagcttggccgtgatgtttgcggtcatgtggttaggttcgccggaagacttgcagcaggtgctattagagagtggttatttgataaaattgctcgcattaagtgccgtaatgggtatcgtggttgtgcttagttgtcatcaaatcaccgccttagtaggtccgatactagcgaatacgcgtggaatggctggaattataacggtgattggggtgctaatcggtgtgctggtgtttgttgccggggccgtctatgcccgattattcacgattcgcgagtggttagtgttgccatatggaaagcggctaattaaggccgttgcaaaaggaaaggaacatcattcatgagtatgcgtttagataagtttttaaaggtttcacgaatcatcaagcggcgctctgttgctaaagaaatcgccgataaggggcggattcaaattaacggtaaggtagcgaagtcttctagtaatgttagcgttgatgatgaactaattattagttttggaaataagacattaacagtcaaagtgacgcagttattggaaacaactaagaaaaatgatgccgagctgatgtatgacatcatcagcgaagactacaaaacggattatcgccaaccatttagtgattaggtcggtgtatccgttcatcgaaatggtcgtaaacgttgacttaatcagcatgatgtcgtttacaccggccgatgaagttgttataatttaggcaacccaatttgaaaggactggaccaacatgacgaacgggtcacgtaacaaaatcaagcagttagataatgattatattcgtcaagttgccaccgacgagcatgggcaagcccagcgtgttgcacaagtacggcggcgacggtttattttgattgttgcggtgttcggagcattgatactattctttggttttcagttgattaatacgcggtccaatctgcaccaggtaaaccgtcaagttgcgaccagtcaagttaaattaaaaaaggtgcagcaaaaaaataatcaacttgagagtcagatcaaacagttgaataataaggattacttacaaaagttattacgttcaaagtatgattatacgaagagtggcgaaacggtctacagcttaccaaatgataatgctgccgatgtaactgccaactaatcggggttgtggtctgctttatatgagtagaccactttttattaattgcttaaatgtataactcaacgtttcacaaagtatgctatactaaaaccattatttcataggaggaacaactttttttatggcaattgaagtaggtacaaaagtcactggtaaggtatctgggattactaattttggtgcatttgtaaacttgggtaataatcaaacggggctagtacacatcagtgaggtttccgatggctttgtaaaggacattcatgatgtcttgagcgtgggcgacgatgttacagtcaaagtgttatccgttggtgatgacggtaagattggcttgtcaatccgtaaagcggttgacaagcctcaaggtgaacatgaacatcatggcaaccatcagggtggcaaccggccaaacaatcatcaaggtaacaaccatggtcatggtgaacgtcaaagcaatggcaatcatcacgatcggtcaaataatttccatagtcgtgggggaaatggcggcggtcgttaccaatcacgacaacatgaacctaagaagcaggactttgattcattgatgtctggtttcttaaaagatagcgaggatcggctagcaaccttaaaacgtaatactgaaggtaagcgtggtggccgtggtggtcgtcgtagctaaacttagtgacttgccattaatctagttaaattttgaagcacggtgcggctatttagagtcacgaccgtgctttttttattgaaaattgccgattgttcaaggtcagtcagcgagacacgttggaaacagtgtgagttaccgtaaacttgcttggctagttcatcttatgctatccagtcggaataatgttcaaataggtgacaaacgaccagccaactaatcggcaagttttaacaataaataaatccaatgtatttataatgaagttagatgggaggttaagatgacaccaattcaaaagttcaatcggcaattagctgcagccaaactgttatcaccacagcaaacagtggtggtagcggtgtcgactggggtcgattcaatggtattgttgcatttgttgcaacgattgccagcagcggaacggccacgggtagtggtggctcatgttaatcatcatttacgcgaacaaagtcaaatggaagcggactacttgcgacaatattgccagcagcaaaacttgaagctagtcatggccgattggctacccgcggcacatcccaagagtggtattgaagcagctgggcgtcagttccggtaccatgtttttgctaaggtgatgcgggaaaatcgtgcaacggcagttttgactgcgcaccacgccaatgatcaagtcgaaacgtatctgatgaagcttgcgcgtggtggcaacatctcacaattgacaggaatcgcaactagtcggccctttgcaacgggccgattaattcggccgttgttgacgtggtcgaaagatcagctacgaaactatgctgccgagcagcatgtcgtttattttgaagacgttactaatcaagatgtggccttgacccgtaatcggattcggcaccgtgtcgtgccagaacttatgacggttaatccccagttattaaagcatgtggccgattaccagcaacagttgacaacgctgttgacggctaaaaagcaaatggtcacggtactactgtcgcaggtcgtaacggccacaggggcgttggttgttgatcagtggggcgcactcccgagccagtggcagttagccgtttttgcgacgtggctcgagcagcagacgcaacaactattcaccgagtcgaagttacaaccgctggtctcgtggggacaacggacgcggcctgccacgagtagattaacggtaaacgcggcctgggagttgtaccgtaacgctggtatcattgaagctttgccaataaaaaaaaggggtaaaaagttaatgccccgtgaaaaaattatggtagacttaaaccaatggcagaaaattactgcaacccaaacggtgggaatctttacgcgggtgccaaatgttgtcagtcagccattttggttaacagaagccgattggccgctagtgtggcggccgtggcaagctggtgatcgaatcgttctcaagggcggtggtcatcagctggtacgtcgactgctgattgatcgaaaagttccggctgaacggcgtgaacaggtgcaagtgttagtgaatgctcaagggaacgttctgtgggtggtcggtcataagtttagctatcgtacgactggtacccagacagtatttttagccttaaaacacgagagttgaaaggagtacatctgaaacgatgaacaacgacattgaacgagtactttatagtcgcgaggatatccatcaggttgcacaaaaattaggaaaagaactcacaactgcatatgctggtaagaacccattaattatttgcgtactcaagggtgccgttttatttaccacggacattattcgtgaaatggatatttacgcggatcttgattttattaatttatcaagttacggtaatgaaacgatctctagtggtgaggttcaactaacgaaggacttagatgctgatgtgacggggcgtgatgtgttagtcattgaagacatcattgataccgggcggacgttgaagttcttgatcgatttgttgaagcggcgcgatgtgaactcagttaaggtctgcacgttattggataaaccagctggtcgactcgttgatattaaggcagattatattggttttgaagtaccgaatgagtttgtggtcggttacggtcttgactatgcagaacgctatcggaacttgccgtacgttgggattttaaaacctgcgatttacgagcataaataattggtcaatgatagtcaaatgtgctattatttagactatcgaagtactgtatataaaagtttcgatgaaggaggcacatatgaacaatcgacgcaatggactctttcgtaatagcttattttacattttgatgtttctgagcttgatgggaattatctactttttctttggcggtaattccggctcacaaacgcaaaatattcgttatagcgaatttgtcaaacaattagataagaataacgttaaaaacgttagtatccagcctagtggcggcgtctacaaggtaactggttcataccggaaagcacggacgacttcttctgcaaacgcccttggtatcaagagcgcatctacaaagacgacgtcattttcaacaacgatgttggaaaacaactccacggttgaccaagtttctaagttggcggctaagcatgacgtcaaggttacggctaaggccgaagaatctagcggcatctgggtcacgttattaatgtacatcgcgccagtcatcctgatgttattcctcttctatatgatgatgggacaagcaggacaaggcggcgggaacaaccgggttatgaactttggtaagaccaaagcaaaaccagctgatagtaagcaaaataaggttcgtttctcagatgttgccggtgaagaagaagaaaagcaagaattggtcgaagttgtcgaattcttgaaagatccgcggaagttcgtgtccttaggtgcacggatcccatctggggtactcctcgaggggcctcctggtactggtaaaacgttgcttgctaaagcggttgccggtgaagctggtgtcccattcttctcaatctctggttctgacttcgtcgaaatgttcgtcggggttggtgctagccgggttcgggacttattcgaacaagctaagaagaacgccccatctatcatctttattgatgaaattgatgcggttggtcggcaacgtggcaatggtatgggcggcggtcatgatgaacgtgaacaaaccctgaaccaattgttagttgaaatggatggttttacaggtaatgaaggtgtcatcgtcatggcggcgacaaaccgttctgatgtacttgatcctgccttacttcgtccaggtcgtttcgaccggaagatcttagttggtcgtccagacgttaagggtcgggaagccatcttaaaagtccatgctaagaataagccattagcagctgacgttgatttgaaggaaattgccaagcaaacacctggattcgtgggtgccgatttggaaaacttattgaacgaagcggccttgttagctgcccgtcgtaataagaagcaagttgacgctgcggatctcgatgaagcagaagatcgggtcattgccggacctgctaagcatgatcgcgttgtgaataagcatgaacgggaaaccgtggcttatcacgaagctggtcatacgattgttggattggtcttgaatgatgcacgggtcgttcataaagtaacgatcgtgccacggggtcgtgctggcggttatgccatcatgttaccacgtgaagatcagatgttgatgtcgaaacgtgatgcgaaggaacaaatggctggtttaatgggtggtcgtgctgctgaagaaattatctttggggcgcaatcatcaggtgcttctaatgactttgaacaggcaacgcaaattgcccgggcaatggttactcaatatgggatgagtgaaaagcttggtcctgttgagttagaaaatgccaaccaacaagcagcttaccaacagggtatgggtgcgagtgccttttcacaacatacggcacaattgatcgatgatgaagtccggcgtttgagccaagaagcgcatcaaactgctacggatattatcgagtcacaccgtgaacagcataagttaattgcggaagccttattgaagtacgaaacattggatgaaaagcaaattctcagtctgtttaagactggtaagatgcctgaaaaggatagtaatgaatttccaagtgagaaagcagctaccttcgaagaatccaaacgtgaattggaacgtcgcgaagctgaaaagcacgcgcaaaaccaaagtgcggatgataagcaagcagactcagctgacactacgactaatgtgagtgttgctgaaccaagtttcccaagtgaatcggatgctagttcagaagttagtgctgacagtagtgtcaattcaacagctaattcagccactgaatcagctaccgacagtgatgtcgcaacttcagccaccggtttaccaaatgctgaaagtgccacaccatcatcgcaggatgatactaattcgcaagcatagtattgaataaagtaaaatgaaggagctgggactttgtctcggctccttttatgcgttatgatatttcaggaaaataaatcaattgcgttaattcggttatgagcgtcgggtcgcaattaaagacggattgagataggagtatgattaaatggcagattatttagtaaaaagcgtcgcgggtaatgagatgtttcgagcgtacgcagttagcgcaacgggcgtggttgctgaagcccaacgccgacatgatacctggagtgcagcatcagcagcgttaggccgcagcttggttggtacgttattattagcatcatcggttttaaagggtgaagaacaaatgaccgttaaaatcaacgggaacggtcctgttggtggtatcgttgttgatggcaatgctaaaggtacggtcaaggggtatttacagcacccccatgtgcacttgcctttgaatgataagcataagatcgatgtgaaggcggctgttggaactgatggctttttatctgtgactaaggatcagggggttggggatccattcaccggaacggttgcgttagtttctggtgaattaggcgaagactttacgtattacttagcacagtccgaacagattccatcagctgttggcttgtcggtgtttgtaaatgacgacaattcgattggagttgccggtggctttttggtgcaagtattgccaaatgcgacggatgaagccatcagctcgctagaaaacaagctcaaagacatgccattagtctcccaattgatgcgtgatggtaagtcaccagaagatattttggatttattatttgatggtgacgttaaggtattagataaaatgccagttaagtttgaatgcgattgttctaaagaacgatttgccgaagcactaatggctttgcccaagcatgaggttcaagcaatgattgatgaagatcatggtgccacggcagtttgtcatttttgtggggaccagtatcagttcagtgaacgcgaactagaagcagtgctctcacggtccaagggtgacgcttaatgaatcaagagtggcagatcggtgatgtgacgattcccaatcgtgtcgtagtggcaccgatggccggcgtgactaacgcggcctttcgagtaatctgcaaggattttggtgcggggttagtcgtttgtgagatgatttctgatcgcgggatcatgtatcataatcgtaagaccctggaaatgatgtttgttgatccaaaagaacatccaatgagtattcaaatctttggtggttcgaaagcaacactggttcaagccgcccagtttgtcgatcagcagaccaatgctgatattattgatattaatatgggctgtccggtgaataaagtggttaagactgatgcgggcgctaagtggcttttaagtccagataaagtctacgagatggtcgcggctgtgactgctgcggttaataaaccagtgacggtcaagatgcgaactggttgggacgcagagcacgtatatgccgtcgagaatgcgcgggctgccgaacgagctggtgcagctgccgttgcaatgcatggacggactcgtaagcagatgtaccaaggccatgctgattgggacgtgttaaaacgggtggcggatgccctcacgattccattgatgggtaatggtgacgttcagacacctcaagatgctgcgcggatgcttgatgaagtcggggccgatgccgtcatgattggccgggcggtagaaggtaatccgtggatgcttacccagacagtacactatttagcaaccggggagttactaacgccacccacaccgatggctaagatgcaaacggcaatggaacatttgcagcggttagtggttttaaaaggtgagcggggcggatgtcatgaattccgtgaacaagcgccgtactatctaaaaggcatcccaaggtcggcacggaccaaagtggctttaatggaggcaagctcgttagcagaaatgatgcgcattttaacgcagtttcaggagcagacggcaacttatttggctagtcacgcggtaaagtgaataattaacttgcattttggcggcgtgattgtcaaaattaacatgtagtgattgtttaggtacggaataaatctgtacgctaactagaaatggaggaacactagtggcacgacaagaacagacgatgaacgaccaactgaaggttcgtcgcgaaaaaatggatgaactgcgtgaagaggggattgatccctttggtcaccggttcgaacggactgatttagcccaggacttgcaagacaagtatggggatatggataaggacgagctagacgctaaacaagtggtggcaaccattgctggacggatgctagctaagcgtggtaagggtaaagtcggttttgctgatatctgggatcgctcaggtaagatgcagttatacattcgtaaagatgtagtcggcgaagatacttaccatatcttcaagcgttctgatattggtgatttccttggaattaccggccaagtttttaagacggactttggcgaattaacgattaaagtaactggtttaacgttcttatcaaaggcgttacgaccattgccagataagttccatgggttacagaatgtggaacagatctatcgccaacggtatttggacttgatctctaaccgcgatagctttgatcgtttcttgaagcggacgaagatcatttcagcgattcggcatcatttagacgatcaaggcttcacagaagttgagacgccaatgttgcataatcaagctggtggtgcggcagcacggccatttgtgactcaccacaatgcgttgaacattgatctctacttacgaattgcgttggaattacatttgaagcgcctgatcgttggtggcatggaaaaggtttatgagattggtcgggttttccgtaatgaagggatggaccgtgaacataatcctgaatttaccatgatggaaacttatgtcgcctatttcgacttccatgatgtaatggctgagacggaaggtatttttaaagccgcagcgcaagccgtaactgacgatggcattgtcacttatcatgatcaaaaagttgatttcaatcaaccatttaagcaaattcacatggtcgatgcgattaaagaaaagactgggattgatttctggcaaccaatgtcaattgaagatgcacaaaaattggcggatgaacatcacgtgaagtatgaaccatactggaaagttggtcatatcattaatgcgttctttgaagaatttgttgaagacacgttgaatgaaccaacctttgtttatggtcatccagttgaaatttcgccattagctaagaagaatgaagaagatccacggtttactgatcgttttgaactcttcatcttaggtaatgaatacgccaatgcgttcagtgaattgaatgatccaattgaccaacggcaacgtttcgaagctcaggctgcggaacggactgctggtaacgacgaagctgaacatattgatgaagactttgtcgaggcgttggaatacgggatgccgcctactggtgggttaggtatcgggattgatcggttggttatgttaatgacggatgcggactcgattcgtgatgtcttacttttcccaacgatgcgtccagaagaagataaataattagatttaaaacggcagttagcttaggttttcctaagctaactgccgtttttgttgggtcagattgagtaactttagttcggaaagcgatttattgaaaaaaagttagattatttttacccgaacattgttgagacatttggaggctaaacttaagtaaaagcggattttatggtggtggtaggtaggatttgaagtcaattaacatgattatggttttaaataccgtatattatcaaagtggattgattaacatgatattattgactggttatttttgcattttagggcttgcaatttatcaggataattggtaaattagtatacgttgttgaggcgcacaaagcggttagccgcttgcttccaacgaaaattaattataaaaagttgttgacaagatgttgataacttgatatgatgattaagttgcgttgaggtaatcaacnnnnnnnnnngttttcagacagtccctagtttttggtgctataaaaggatttaagactatttatgtatggtggatattaatttaattaatggttattagattagaaaacggttagtgctattgttgattaagattaaggctagtataatagttattatgtttaattaagaaacaaaacttgttacttttaaacgaaatacaaactggttaagaagtttggaggaatctctattggataaggaacaaaagctggatcggtcgttctttggccaaccccgtggcttacggacgttgttcttcactgaaatgtgggaacgattcagttactacgggatgcgtgcgctactgatctattacatgtactacagtgtcgctaaaggtggtcttggatttgaccaagtcaccgcagcatccattatgtcaatctattcggcattagtttacgtttctagtgtcctcggtggctttctaagtgaccgtgtctggggtagccgtaagaccgtctttattggtggggtcttcatcatgttaggccacatcgttttatcaacgccatttggagttggtgcactatttgtttcaatcgcacttattgtcattgggactgggttattaaagccaaacgtctctgacatggttggtcaattgtatacagtggaagatacacgtcgggatgctggttttagtattttcgtcttcgggattaacttaggttcattggttgcaccagccttagttggtcggatcggcttaaatgttaacttccacttaggcttctccttagctgcgattgggatgttctttggtctattgcaatactactttgatggtaagaagaatttaagttctgctagcctctatccaactgatccattagaacccggtgatttgaaaaaaatcatgcggtggacaatcttaggaatcgttgggattgggttgattctactattaatgcaattaatgaatgctcttacgttagcaaatgttattagtttaattagtacgcttgttatcttgacaccaatcgtttactttattttgatgttaacgtctgacaagactaatgcaacagaacgttcacgtgttcgggcttatatcccattgtttattgccgctgctttattctgggcaattgaagaacagggttcgtccgtacttgcgttatttgcagctaatcgggttaatttggatcttggttttacccatctagctgcttctgatttccaaatgctaaacccattgttcatcatgatttatacaacaccattcgtgtggttgtggactaagtggggtaaaaaacaacctagttcaccaactaaatttgcgattgggttgctattcgctggggcttcttacctagtgatggctgtacctggagcgctctttggaactgcagggaaggttagtccatggtggttagttgccagttgggcagtcgttgaaattgctgaaatgttgatttcaccaattggtttatcagttaccaccaagcttgcaccaaaggcttttgcttctcagatgatgagtatgtggttcctaactgattcggttggtagtgcgcttaatgcacagattgtccgtttctactcgacgcaaaccgaagtgccatattttgcgattaccgggattgttagtgtcgttttagggattatcctctttatgatggtgccaatgattaaacggtcgatgcaaggcattcgctaaattgaatatttactcgaagatatgttatcttagtggtagcatatcttttttgttttggaggggttgaccatcgtacgaattgctttcagtagtgataatcattttgatgttaatcgagtggatgcgactgcgatgatgcgatctcaggcgacctatcttttacagaatggtgttcagatttatttgattgctggcgatctttttaatgactttcagcgtagtcagcagtttgtcgtcgatttacaggccctattaggcgcacagacgtgtgtttactggattgcgggtaatcatgacatggtccatggcatttcgtttgacgagcttgaaacagggcattttgatggctacctgcataaccggtatatcgatatttctggtacagattggcgcgtgattggacataatgggtggtatgactatcagtatgctgcccaggtccctgatacgactgcggccgacttcttacactggaagaatgcgttttggatcgaccgggctattaaacagccgatgagcgatcaggagcggactgatttaatgctcaaccaagtaaaagcgcagcttaacttggctgctgtggatcacaagcaagttatttttatgacgcactttgttccccggatcgattatttgcgtttttctgatgataatcggttttggaatatggctaacgcgttaatgggaacgccccggttaggacaactgttggagcagtttaacgtggcgcacgttttatttggtcatttgcacgtccatccgcaaccgcgggtgtttggtcagaccacctattatgaccaagcagtgggctatggactcaagcgtatcaatgaatggcaagccaataattttatggcggagtggtatcaagatacgcaaattctggatttgaaataaaaactgaaaaaactttgaaaaaagtcttgattttttattcaaaattatgtattctaatatagttgaatgatttacggaggggtagcgaagtctggctaaacgcggcggactgtaaatccgctccttcgggttcggtggttcgaatccactcccctccatttcattattgggctatagccaagtggtaaggcaacgggttttgatcccgtgatgcgctggttcgaacccagctagcccaattgttacgcctttcgtcgttaatcaggtcttaagatcttgatgtaacgacttttttattggcttaaatttatcttaatatcggcgggtagtgccacttcgtgaagaatgcgtaacggattcttcacgaagtggatttttttgtctcggtctgtttatttgccatcatcaataataatgtgatatgttttagtattctatttggggcacgatccagatgggataggaggtctggtcaatgaatttatttattccgtaagtacacggaagaggttaatggctggcattgttaattttaaaaatacgtactagttaactcgtcatgacggccatcacaattattatgagtcgttcttataaaagcacaccaatttttaaagcacatatgggttatggaaagaagcgcgctaaccgtgctgttcgaaatcgtatgaatcgtggtgaatttgatgttttgccggctaattcgcatgcctggtataaacgatgttatgagcagtatgatgttgtcgattattgctccagagagacttattcgcaagttcaacttgagctggagacgatgcgattagagattactcgtaacggtgggattattcgaagaatcccacaacatctggttgttacgtatacttttgatccggtgatatctgatattgtgcacatgcagcgaacggaagaactaattcctgcgcaagatgtccaaatgtttgtaggtacttttgaacagtggtgtcgggagcgtcgcaactgctgggccaaggcttattatcgaaaataagtcgtattggaacttgatctatgagatttggttgaagaggctacgtagccttagttgtcccactaccagccccaactagttgactgaataaatcaaattttccacagaactgttatcaaatgtagtaacagcagactgttcagcgtcgcaatgacgcttggacagctttttgcatggcccatatctggatgcaaaggcatttacctgccagagatgacgtggttattaagtatatgactagtagtcagttattcagaattataagatgtttattcaatcgaacctcgaaaattgagtttgttagcgttaagcttaatttagggaatcataccatcatgaataacgtaagcgaccatgatgatgaccaaggaggatttgaaatggcggtaactaaaattgatttaaaaaccacgatgacttaccgggagcatgcaattactagtaaatcatttgctcgaaaattagggattgaactgccgtttgcgatgtacgcaatggcggcgggtgaaagtattagtgctgaacaatccacgctgacccgcttatttgaggttgttgatggtactttgaccgtccgtttggcgacggagaccgaccaagaagtgcatgcgggcgagatgttagtggtgccagctcatacggtccatacgttggtcgctgagcagccgtgccagtttattcaattagaaacgaaataggccttaatagcgagatgcggaggaattcaaatgagtttaattaacaaaattgatcatgctaaggtcctcaatttaactgaacaaattccactggatgatgatcaagttaatagccggacactggttcaacgggatgatttaagtatgacgctattttcagtcgcaaccgaccaagagattggcggccattctgcccagggcgatgcgatggtcaatattttaagtggagaagcggaaattacgattgaaggcaccatttatcatttaactgcgggacaatcgatcgtgattcctaaggatgcccggcacgcgttatatgccgttcaaggatttcagatgttattggtggtcgttaaacccgactaatgcacgtggttatcgatgagacggagggagtaatatgccgctgtatacgtttattggtgatattcatagtgccgcggatgatctggcagttttattagccgatcctgaagttaccgcgacgcgcttgattttcttgggcgattatattgatggtacggcggcacgctattttggtcatgccaccgagtcagctccgttggcgccgctaaaagtactgacgatggttagaaaacgggtacgggaatacggcgatgtggctttacttggcaatcatgatgaattttggctacggacagctcatggtgatgacaatgccaccgcaacttgggtgttgaacggtggtcaccggacctggcgcaaattagggatttactcctccaatcccaatcatgttcggcgggcattaaatggtgcgctattaaagccggatactgatttcttagcacatttgccgctgatgtggcaacatggtcggttactggctatgcacgcgggtgttaactggcaatacccattaacacaacaaacaacgactgacctactgtggattcgggatgactattatgatgacttcacgactggcagtcaccgttggcatcggaacttattcaataaagtcatcattactggtcatacgcaggtgcagaccttgactggttcacacactggttatttaaagatgcaggcagatgcgcaagacgttccacgatatctaattgatgcaggcagtcgttcaggcctgtttgatggtggaatttgtgcgttaacgctgacggtcgatggtgaatttgtcagggcgaaacgcgtgatcaagggtcaccgctacgatggtcagcaaatcgtcactccggccatgttggtggatcaggcgcactaagtatcactaaacatctcagagatagaacgtaaaaggagcaggctcacatgatattgagactgctccttttatgatgtcacgctagttactggttttcgcactatttcaagttgattggtttgcaagttctcactgaatcgttactcagcgtaactgaattataggtgtaaatagaaccagccaccaaggcctaaaatgaacaggccaagtccattgagggccgtaaacacgatcaaaaaatggtggagtggttgttcatcattgaagggcaacaattgttttaaggcaagcagatttgctagtgaggccaccaatgaccccagaccgccgatattgacgcctaaaaatagcgctgataaatggggcgtgaaattcgctagtaagatggcggctggaacattgctgatgacttggctagtaattagtccagtaatatagacactgggggctgtctgagttaattggttgagccaatgcgttattgcgggattatgactgatggcgctaacgaagatgaagaagcagataaaggttaagagtagtgcgtaatcaacgtactgaaagacgcgtcggttaatcatgaggcctacgacaatcgttccgataataactagtgaaatgggcaccaaattaaaaatgccaagcataatgaaactgagcaggccgcccgcaagcccgatttgactgcgagaaatgggcgtagatttggttggtgttacagttagcggcaaccgaggtaaccgccggcttaaggcaactaataaagctagactagcaagcattaacggagtcgacaatttaaaaaacgtgaatagattaacgtgatagaacgtgaccaaaaataaattttggggattgccaatgggcgtaaacgcgctaccaagattggctgccatgataattaaagtcgttgggtaggcaatggccaggtgctgccgccgggcgagtgtgagaaagattggaattaacgttaggatcgcaacgtcgttagttaaaatcattgagccaccaaaggccagtaagatgaataattgacacatttgacgggtatcgtgtgatttaactaagagccagtcccttaaagtatcaagcaaatgcatcgcgcgaagtaattgaacactgatcatgagtgcaaataaggtgccaatcgtagcccaattaattgccgtcagttggggtgtcccgatgaacaaacttaaaccagcacaaattaatgcaataataaagattttatcgtgaagtgtgcgacgaacgactgtcaccatggtaaacgtccccctcaatagtcagttaattagttctaacttaaacaaactcgtcgctaaatgtaaactgatagacatttttcagataaggatgtagccacccgaacggtaacccaaataaaaaatcgcttcaaagttatgtgtttaactttgaagcgattagtgcttggttttgattgccagttagcttgcttaatgtgtatctagtttatcttgctgagtgttttgaccgaagaaccacaagtaggcaccatataacgcgttagcgagcatcactagttgcaatgctaacattgaggcggctgcaggactgaagccttttaattggttgaaccagataataacgttaatcacgtcgagtgtgatccacgcaacccattgggaacgataaccgttgaccatgaggacactaccgacaatcccaagtggtaacagggtcgcgtccaggtagatttggttaccgttaagttgtttactaaagtgtaagacaatggcgtagacgagtacggctaacgcgaaccaggcacaaccggctaatttgctcaatttacgaccagtcagttcgctggcatcgggttgcgctgccattttacgatgccagacggtgatgccgacaaattgcatgataaggtaaaatgattgcgacgcaatgtcaccaatcagccgattggtgatggccgtagtaagccaagccgcacaggcaataatgccccaactatagttcgtcagtcgcccttgatcaaccagaattaagttaatcacgaccgtaatcccggtcaataggccaatccagccatgtaggctgtaatcgcgacccagaataaaaccaatgatggtcacgattagcatcgtgctcatcatcaacttagtggtgcggcgaagcgtctttaattcattaagtccccgttgccagctgaagacggcgcgcatggccgtgggcagactagtgatgtcttgctggcattgttgcagcagggttgataaggtgagtcggaaatggttgttctggttcatagtgaaacactccttagttgtttttagacagccgtgttcggaagcaacgctgtgtttgattgctgtttacattagcttgttcaagcagacctgtcaacgagcttcgcacatattgaaggccgattattaatagattaatcaattggtttcagtattgataagcaatcaccttaatagagtggctcgtgatatttatttgttgatagtgaaagttgagctgaaagaagtgattaattacccacagtttcacaaatattggtatagtagaagagtaagcgggaatgtctgtttaatcctgcctagccgttaatcggttagtggttaatgatataaattataagtcagaggagcgttttacggatgaaaatcggatttattggtgccggtaacatgggccgcgcgattattgatgggtggttaaaacaacaagcggtcgtcccagcagatatttatattcacagtgcccatgttgcgagttatcaaccttatgcgcaaaaaaatgggctacaggcctgtgacactaatttggccgtggcacaagctgctgacgttatcgttttggcagttaagccgaacattgcgttggccgcattaaaagaagttcaagcagctttaacgggcaagtgggttattacaatggtatcaggattgagtttggccgattatgccacggttgtccctgatctccccgttctgagaatcatgccgaatgtgaacgtggcgattggtgccgggatgacggcgttggttggtaatgatgccttaacaccagagcaatatgcggctggacaacaattattcgatgcgattggtgccacgagtgccatcgctgagaaagattttccaactttttcagccttagcaggtagttcgccggcctacatctatttctttattgacgcgatggcccgcgcaggcgtcaagcacggtttgagcaaggatgcagcgactaagattgcggcgcaggccacgctgggcagtgcgcagaatgttttagcttctgataaaattccgtttgacctgatcgatcaagtttcttcacctggtggcacgacggttgctggattactggccatggaagaggccggctttatgaccgcagtggtgaagggaattgatgcaacgattgcgaaggaacttggcgaatcttaaattacttggtgctggtggttgcaagtttggtctataccgattataattaaaccagataaatccaaggaggaattgttcatgagcaaagtgttaaaacatgccatcatttatactggtctagaaaagatcgatgacggctacattcgtttcggtaaggaaattgaagcggttggtccaatggatgactacgtggcccaacccgatgatgatatcgaatttgtgagtggcaaaacgattgtaccgggcttcattgatgttcatagccatggtggttatagttttgattcaatggacgggaatccagctgaaattaacgaaatggttaatgatatggttgcccgcgaaggtattacgtcatacttctgtacgaccatgacgcaatccaacgaaaacttagaccattcgatggccggtattaacaaggccgccgatgaaaatccggttatccaaggggttcatttggaaggcccattcatttcggcgacgtttaagggtgcccaacctgaaaagtacattaagaatcctaacgttgacttattagacaactggaacaagttgtcgggtggtcgggttaagttgattacttacgcgccggaagatcctggttcgcgtgaatttgaaaagtactgcttggaaaatggcattgtgccttcagtgggccacagtaacgcgactcgtgaacaattattagcaagtaaagcaactcacgtgacgcatttatacaacgcgcaacgtgaattcaagcaccgtgaaccaggtgttactggtcatgccatgcttgaaaacaacatgtactgtgaattgatctgtgatgggttccatatcgtgcctgacatgatcaagctcgcttacgaacaaaagggcgttgaccggatcgaattggtgactgattcaatgcgtgccaagggtgaacccgacggtatcagtgaattaggtggtcaaaaagtgattgttaaggatggtcaagcacgtcttgaagaaggtaacttggctggttctgtcctgacattcattaatgccttcaagaacattcagaagttcaccggttgcggcattgctgaagcggttaagatggcttctgtcaaccaagcacgtgaatttgggttgactaagaaaggaacattggaagccggtaaagatgctgatatcaacatcttagatggcaatcaagatttagtcgcaacatatagctacggtaaaaaagcagctaaataaattagaagtaagggatgagtaccatgagttcgccaatttatattcaaatccacaaccaaattaagcaggcgattgaagcaggtcggtgggccgttggtgaccggattccgtctgaacgggagctggctacacagttcgatgttagtcggatgacccttcgacaagcaatccagacattggttgacgaaggaatattagagcggcgagtcggtgccggcacgtttgtcgcgaatcagaaggtccaagaaaaaatgtccggtgtcaccagttttactgatctaatgctggcccagggtaaggtcccatcaagtaagacgatttcatatcacgtgacgagcccgtcgctatctgagagcgaaaagttggcgttaggcgccaacgaacaagttctacggatggaacgaattcgctatggtgatgatgtgccaatttgttttgaggtcgcaacagttccagaacgactcgtcaagcagttcaccaaggacgaaattacgagttcgttgtatcggacgttggaagagaaggcaagtttagtgcctggtaaggctcaacagactgtttcggcgatgtctgcttctgagcgtatcgcagaatacttgtcagtccggcgtggcgatgcgttgctacggttacggcagatttcgtatctgcaaaccggcgaaccgtttgaatacgtgcggacccagtacgttggtaaccggtttgagttttatcttgaaaaataaccagtcggtcgggtgctgggcacctgattagagtgatgataccaaaaatagctcacctaggatgttattctaggtgagctatttttgaattcatgactgaagactgggtacacgcacaaaagcaattgtcatcgtaacgcagtggcttataactggtaatgattgccagttaattggcttgctggcgcgctatttttttaactaaccgcaagtagcggggtaacacgagcatccgcttgaaacgacttggttcttgaatcagacggtagagccattcaacgtggtgtttttgccaaaataacggcgcccgcttaaccgcgcctgcaattacgtcgaagctacccccgacacccatccagagcgcatcgaggcgttgacggtgttcggcaatgaaaaattcctgcttaggaaaaccagtggctacgaagaccatatcgggttgcgcggccacgatttggtcgacaacggtttgttcgtcgtcataatagccatcacgggcacccgcgacaacgatgccgggataagctcgttgaacgatcgtggtcacttgctttaacacggccggcttggcacctaacaaaaagatccgttggtgctgttggctaccccattctagtagtgttaaaagggtgtcatagccggtgatccgttcggggagtggtgtgccaagaatctgggccccctgaatgacgccaatgccgtctggcgtgatatagtccgcttgcgttaacacctgttggtaatcggggtgttcacgagcgtacattaagatctcggggttagcggtcaccacaaagcgattgcgatgcgcgagaatatcggtttgaagttgctgaacaaaaccagcgttagttgtcttgataaacggcacgtttaagatgttaaccgtgtcaaaagggactgacataagcgacctcactttctaatcataattaaagtataggtaaatcaacgaattctgcaactttttggatgcttaagcgcattcttttataaaaaatgctaaaataagcttaacttactgtaaacacggttattacctacgaaatggagaattatactcatgacgcaaatctatccggatgatagttttaccttgcatacggatgcttatcaaattaatatgatccaaacctactgggaacaaggtattcacaacaaacatgcggtgtttgaagtgttctttcgtaagatgccgttccaaaatgggtacgcggtatttgcgggtctggaacgagttgttaattatatcaatcatttacattttacggcaactgacatcgcatatttacgtgaactgggtggctactcagacggttttctagattatttagcgaatttcaaatttgatgcgacgattcgtgcggttcgtgaaggagacttggtctttaataatgaaccgttgttacaagtcgaaggaccactggccacttgtcagttaattgaaacggcactactcaatattatcaattatcaaacgctgattgcgactaaagcggcgcgcattaagtcggttgtcggtgaagatggcttgctagaattcggtactcggcgggcgcaagagtttgatgcggccatctggggaacccgggcggcttatattggtggctttgacgcgacgagtaacgtgcgggctggcaaaatttttggtattccgattagcgggacccatgcgcatgcgctcgtgcagacttatcgaaacgattatcaagctttcaaggcctatgcggagacccatcatgactgtgtctttctagtggatacgtatgatacgttacgtagcggggtgccgagtgcgattcgagtggctaaggaaatgggtgataaaatcaatttccaaggggttcgtatcgatagtggcgatatggcttacttatcaaaacgcgtgcgtgaacagctagacgaagctggttttccggatgccaagatttatgcgtcaaatgatttggacgaaaaaacgatccaaaacttgaagatgcaaggtgctaaaattagtgtctggggtgttgggacgaagctaatcacggcctttgaccaacccgcgttaggggccgtgtacaagatggtttcgatcgagaatgatcatcatcagatggttgatacgatcaaactttcaaataacgcggaaaaggtctcaacgcctggtcaaaaacaagtttggcggattacgaagcgtgcggatggcaagtcagaaggtgactatgtgacgttgtacgatgaagatccgcgcaacgaagaatcaatttacatgttccatccaagctatacgtatattaataagacggtcagcgattttgatgcgcgaccactattggttcccatctatgaccgcggtcaacaagtttatactttaccaacgttagatgaaatcaaggagtattcatttgaaagtctagatgcactctgggacgaatacaagcgggatttaaaccctcaggattacccggtcgacttgtcacaaaaactttatgatcataaaatgaatattattaacacggtcagagaccacgttaaccataaagatgaggaggaagcttactaatgcggccattacaagctgagattattaaagcgttacacgttgcaccaacgattgatccagaagttgagattcgtcgaagtattgattttttgaaggcttatttaactaaaaatacctttttgaagacctatgtgcttggcatctctggcggtcaagattccacgttagctggaaaattgacggagatggccattaccgaaatgcggcaggaaacgggtgatgatcgctatcaattcatcgcagtccggttaccatatggcaatcaagcggatgaagcggatgcgatggcagcgattgattttatgcaagccgacgtgacggatcgggtggatattcaaccggctacggatgccatggtaactgcattgaaagctaaccaattgacgattcatgatttcaacaagggcaatattaaagcgcgccaacgcatgatcgtgcaatatgggattgctggtgaaatgcacggcgctgtcgtgggaaccgaccatgcagccgaagctgttactggtttttataccaagtacggtgacggtggtgcggatattgtgccactatggcgattgaacaagcgtcaaggtaaacaaatgctggccgctttagatgcgcccaagcatttgtatgacaaagtcccgaccgctgacttggaagaagatcggccagcattacctgatgaagtcgcgttaggtgttcgttacgacgacatcgacgattacttggaaggccggacggtcagcgatgctgcggccgaaaagattgaggcgtggtacttaaagactgcccacaaacggcacgcggccatcactgtgtttgatgatttttggaaataagctagttagctgataatcgattaggattacggctaacctaattaaaaaggcgacttgaagattattcagcttcaggtcgcctttttgcatagtcacataattttatggtgactaccgtaatattggtgggattggtggaaaagcggtagaatggtttaaaatatgtaaacgcttaatgtgagaatatccaagtgctgtggcgaatgcagaggtagtcaaagcgattattttgctagacagctcccatggaatctggtattcttacgatacaatcataagggagtaactagcagaaatattctgcggcaatatcgtcagcaagaagccaatccggtattgtcttaaatagtgagacttatgtatgttcacacaattttgcgtgcatacatgagtctcattttttatctggagatcagttagggagtggggctcggatgccagaaaaggagcttacgatgagtacaaaaccaaagtatcaacaagcgttatccgccgtttatgaggaactaggcactgatgaatacggcttacagcaaagtgctgcgtcgcaacggttagaacaatatgggccgaatgcgttgaatcagcaaaaaacgacttccttgttgcaaaaatttattgcgcagttcaaggatttcatgattatcgtcctgttagtggccgccttgattgccgcctttactggggaagccgtcgatgccgttatcatcttattggtggtggtattaaatgcgattttcggtgtcttccaggaatcgaaagcggaagaggccatcaacgcgttgaaggaaatgtcagcgccggacgcgactgttttacgggatggtcagctgcaaacggtcaagagtgacgcgttggttcctggggatgttgtgtcgctagaagccggggatatcgttcccgcggatttacgattaattgagagtgcgtcattgaaggttgaagaatcggcgctgacgggtgaatctgtcccagttgagaagcaggcggagatgattgccgatggggaattaccaatcggggaccggttaaacatggcgtacatgaatagtaacgtgacgtatggtcgggccactgggattgtggtggcgactgggatgcagactgaagtaggtcgaattgccggcatgattgaagcggccgatgagacgaccacaccactgcaagcgaacttgacacagttagggaagtcgctgacgattttaatcttagttattgccgcagtggtatttggtatcggaatgttgcgcggtcaagagagtttgatcaacatgttattgacggcgatttcgttagccgtagccgcaattccagaagggttgccggcaatcgttacgatcacgttagcgttaggaacccagcggatggccaaacggcatgcgttagtacgaaaattacccgcagttgaaacgttgggaagtaccgatattattgcctctgataagaccggaacgttgacgcaaaacaaaatgaccgttgaaaagttggtcgtcaaccaggaactggtggacgcgcgcgctactgaattgccgcttgatagccatttagcgcaagtgatgattttaagtaatgatacaaagatcatgccggatgggttagcaggtgacccaacggaaacagcgttgattcaatataatttggatcagggttatccagtcgatcagttgttgacggaccgtccccgagtgacagaagtcccctttgattcggaacgtaaattgatgtcgacggtgcaccccttagaagatggtcgcttcttagtagccgtcaagggggctcctgatgaattacttaaacgggtcactcagattgaaagtaacggtgacgttcagccgttaaccaagacaagccgtgaccagattctaactgttaatcatgaattggcaacgcaagccttacgggtcttagcatttgcttataaagtgatcaccacggttccaacgactgttaatacggagacgttagaaaatgacctggtctttgccgggatggtcggcatgattgatccagaacggccagaagttgaacaagccgttgcagaagctaaatcagctggaattcggccgttgatgatcacgggtgaccaccgtgataccgccgaagcaattgccgtccgtcttggtatcattaacgctggcgaagatgacgctgtgattactggtgccgagttagatgcaatgagtgatgcggaattcggcaaaaaggtcggcgattactcggtgtatgcccgggtggcgcctgaacacaaagttcgaatcgtgaacgcatggcaaaaacgaggcaaagttgttgctatgactggtgatggggtcaacgatgcgcccgccttgaaggctgctgatatcggtattggtatgggaatcactgggacggaagtttccaagggggctagtgacatggtcttggctgatgataacttcgccacgatcgtggttgctgtcgaggaaggccgaaaagtgttcgccaatattcaaaaggcgattcagtaccttttgtcagcaaacttaggggaagtcttaaccttgttcgtgatgacgatgttgggctggcaaatcttggcaccagtgcatatcttatggatcaacctagtgaccgacaccttgccagcaattgccttaggcgttgaaccaactgaaaagaacattatgcagcataaaccgcgcgggagaaattctaatttcttctcaggtggggtcttcagcagtattatttatcaagggctactggaaggtggcattacgttgctcgtgtactggttagctttgacgtatccggttcacgcaacggcctcattagctcatgctgatgcgttaacgatggctttcgcgacccttggcttgattcagttgttccacgcgtttaattctaaatccattcatgaatcgttgtttacggtcggcttgttccgaaacaagttctttaattgggcgattctaattgcatttgtgatgctggcgatgacaatcgtcgttcccggtctgaatgggttattccacgtgagtcacttggatgcttaccaatggggaatcgtggccttagcttccttatcgatggtcgtgattgttgaaattgttaagttcttccaacgtcgacacatgcggcgcgcataacccatccattaggggtaaaataaggctaactaatttaaagaaaagagtttgtacatgaaaaaagcaacgattcaaacgtatatgccagtactgtctaaagttatcgaaagtactgaaaaaatgggggaagaattaaacccatcttttgaaaaactacgtcaggccattgataatgacgcagttgccaaaatggttccagctgaattcaatgatattcagatggaatttagcgatggtactgaacagtatcaacaaaatttggcacagttgaaaaaagttgcggtacccgcacggttaatggggcggcaccgtaatttgttagcagcatacgaagcctacacgaatgcgtgtgcggccatgacggctagcatgaacatcgacaatcaaacgattgatgtggctgcttttaatcaggctgaaacggatcaagagactgaaatgggccgcgtttcaaataacgtgcaacggatcatgaatacagtcatgtaggagcgctaatctgggtgattggatttagcacactaataaaacgctcggtaacgtttatgcgttgccgagcgttttattgttggttgcggggcagccaactgtgcggccgcgccgtgctcgtttagcctaatgggctggttttttccagctcacaaccaatgtgtgaacagtatcggtaatggcttcgattggtagtgacagtcaacgacaattttcagatggtcattcggcgcggaaacttgggtaaaacgcgtataatataatgtaatgagattaaaagattgggtgaaataatggataatcagattttaacgttagttaatcaaacgctgacgaagtttaaaccgcaacagatcaaagcggttctcggactcatggacgaaggcaacaccgttccgtttatcgcacggtatcgaaaggaacgtaccggtaacttagatgaagttgaaattcgcgaaattaaagataactatgatcggcttgcgagtctagagagtcgtaaggcagatgtgatgaagttgatcgctgaacaagatcacttgacgccggctttaaagcaagccattgaaaaagctgacaagttgcaagatgtcgaagatttgtacttaccgtacaaacagaagcgacgtacgaaggcaacgattgcgaaagatgctggactggagccgttagcagcttggttattacgttttccggcaagtggtattcaggaacacgcggcgcagtttgtgaacgaagcgcaggacatcacagacgcgaataccgcgttagctggagctcacgaaatcttggctgaggcctttggtgataatgccggtttacgaaactgggtccggaattatacgcgtgaccggggcttactagtcgcaaaagtgaaacccaagggtaaagcagccgatgaacaaggtgtttaccaacagtattatgattttaatagtcccatcaagcagatggtaccgtaccgggtactggctatcaaccgtggggaagccgaaaaagtattgaaagtcagcattgatgttgatcgtgctggaattgaccggtattgtcattttcgctttattggtcagcaccacggcccagcgattgaactagtagaagctgcttatcaggatgcctacaaacgctttattggcccagccatcgaacgtgaacttcgcaatgaattgagtgcggctgccaatgaacaggccatcaaagtctttggcgataatttgtaccacttattaatgcaggcaccattaaaaggtcgcgtggtattagggttcgaccctgcttaccggacggggtgtaaattagccgtgatggacgcgaatggtaagttcttagataagctcgtgatttatccacacaaaccagctccaactgccaaacgggaagctgctgcgggtgagtttaaaacctttttggagaagtatcatgttgaaatgattgcgattggtaacgggacggcttcccgcgaatccgaggagtttgtggcacaggtattgaagactatgacccgaccggtttattatgtcatcgtgaacgaagccggggcttccgtgtactctgctagtgctaaggcgcgcgccgaatttcctgagctacacgttgaacaacgtagtgcgattagtatcggccggcgactacaagacccactggcagaattgatcaaaatcgatccgaagtcagtgggagtggggcaataccaacacgatgtgccccagaaggaattgacaacgcagctagatacggtgattgagaccgcggttaaccaagttggggtcaatttgaataccgctagttcggagctattgacgcatatttcggggctatccagcacgattgcccaaaatgtgattacttatcgggatgaaaatggcgaattcacgagccgaccacaattgaaaaaagtgccgcggttgggaccgaaagcttatgaacaagcggtcggcttcctgcgaatcattgacggcaagaatgtttttgataacacggatattcatccagaaagttatcccgcagccaaagcgttattggcagcggctggattgaagacgacggacgttgggacgactaaagcccaacagttgaatcaattagatttagcgcaacttgcgaccagcaccggtgtcggtgaactgaccttaaaggatattattagtagtttgcaaaagcccgggcgtgatgttcgtgatacgatgcccgcaccgttactccggcaagacgttttaaagatgagtgatctaaaaccagggatgcagttgcaaggaaccgtacgcaacgtggtcgactttggggcgtttgtggatattggtgtcaagcaagatggcctcgtacatgtctccaaactaacggataagttcttgaaagatccgcgtcaggcggtggcagttggcgacatcgtaacggtgtgggtcgaagcagttgatgaacagcggcagcgcatcgctttgacgatgattgcaccggctgaagcataatgactgatttagagttacagcagctcgttgcgaccatttccatgcgtgattttcaccgtccgttccagcaccgcgcttattttaatgctcggttacgaacgacgggtggtcgttatcagttggcctcgcatgatattgatatcaatccgaagatgctgactgattttgatgaggccaccttgattggcgtcatcaagcatgaattgtgccattatcatttacatttgactaagcggggatatcggcatcgtgatgcagactttaaacgattactcgcgcaagtgggtggctcgcgctatgcaccagcgccgaagcaggcgacggcccggccgtatcggtatatttatgaatgccaacggtgtggccagcggtattaccgcaagcgccgcatggacactcgccgctatacgtgtggtcgttgtcaggggccaattaaattagtctgaaaaggtttgctaaagtggtacgcttccgatagaattagcttaactattgatatggagggattaagatggaaacgattaaaattggtgtggtcggactaggcacagtcgggaccggcgttgtaaaaatgcttcaagcgcatcaggaaaagatttcagaaattaccggtcgtaagttggaactagcctgcgtagttgtccacaacttgaaaaagcacgaacaagttgatttgggggacgttcagatgaccgaccaaatcgcgaccctgcttgatgatccgtccattcaaattatggtcgaagtgatgggttcaattcatccggcgaaggaatatattacgcaagccttgcaagctggcaaacacgtggtgacggccaataaggacttgattgcgcaatatggccgggagttggttcagattgctcgtgaaaatcatcgcgacttattctatgaagctagtgttgctggtgggattccaattttacggacgattgataatagtttcgccgctgaccggattcaacgggtcatgggaatcgtcaacgggaccactaattacatcatgacgcagatgctgactaagcattggtcgtatgatcaagccttgagctcagcacaagacttggggtttgccgaaagtgatcccactaatgatgtcgaaggccttgatgcggcgttcaagatgattattttaacgcagtttgcctttgggatgagtctttccctcgaccacgttcaagttcagggaattacgaaaatcagcccagaggatattgcggaagctcaccagcttgggtatacaattaaattactcgggattgcggaagaaattgacgatcgcattgcggtctcagtcgggcctgtgcttgtttctgatcagcatccacttgccacggtacaaaatgaaaataatgctgtaatggtaacgggaacggctgtggggaacacgatgttttacggtcctggcgctggagaactcccgaccgccaacagtgtgctgagtgatattacaacggttgcgaaaaatattgcgttgaatacgactggtaacacgtttaactcttatcgccaggagacagtcttagcaacgcctgaagatgttgtgtatcctcactttattgccttgaagatgcgtgatgtgccggggatgatgatgaaattgacggcgattatgacccgcgcagaagtttcatttagtcgaatcattcaaaatcaattaggtgacggcaacgctcgtgttgtgatcattacccatgccatgaatgatcaacagttagcagatatcactcgtgaaatcggtgaacaagagaatatgcaactattagcgagttataaagttttaaagaatgcgtaggtgaggacatgttaacgatttcggttccggcgacttccgctaatcttggtcccggttttgattcaatcggtctggcgctggacatgcaactaacgctacaagtgttgcaacctagtgatcattggcagattgaccatccctttggggcggatgtgccgacggatgaacgcaacttaattattaaaacggcgttgcatttggtaccagatttacaaccacagcatttacagatggcttcaaaaatcccgttagcgcgcggattgggtagtagctcgacggccatcgtagccggcttagtgctggcaaatgaattgaccggcgcaacgcactcttctgctgagctactggaagttgccactcaactggagggtcatccagataacgttgcaccagccctattaggaggcttggttgtggcgacgaacactgatgaacgcgtccgtgcggtgaagttacagttaccgatgctttttgcaagtgtctacgtgcctaacgaaccgctattgacgaccgccagtcgccaagccttgccaactgaattggcgtaccaccaagccgttactggtagtagtgtggcgaatacgttagtggctgctctagcaactcaaaattgggacgtggcgttaccgctgctagaacaggaccagttccatgaacagtatcgggctaagttagtgccggcactacaaacggttagagaccatgcccacgctctgggattaacggggacttatttgagtggtgctgggccgacagtgattactttgggtgattacgggcaactcgctacgttgcaggcgcaattgagccgagatgcaacactcaccggccaattattcctattgccaatggatgcaactggtgtaaaagtacaaaaatcttaaaataagcttgtcagactcgcaaaattttgttatgatattttttgtgagttgtgatgcggccatggcggaattggcagacgcgcaagattaaggatcttgtcggggttaacccggtggaagttcgaatcttcttggccgcactaacgaatataagaatcgatttcgataggttaagccttgaaggatcgattctttttttgttgcggtaaattggactggtcacgttatttcaggcttgcttttttgccaactacttcaactatgttcaccaaatttgccgtaccttattgtttaatctcatgattaccagcattataatgaaaacggttaatctactgattacgatattaagagaaggcgaggaccaggcattgattagaatgagtagatggtggtggcgtatcttggtgggcggagtgcttgttagtgcccgcacaagcggccgtaacgacttatccgattacagggattcaggtggtgcagacgcgggtctatcagacgaatagtcagaacggtgtcggttaccatttaaccgtcgtgcgtcatcagcgtgcccaattgcgtgttaatttacatttaaagtatcaccagcatacacagtggacgcgtactgagcaagctggtatttatcgcaacgggcattaccagcgcttctactacgtgcataatggtcatcagcagagcggctggatagctgctaatcagctaaaacccgccagtacggcgtcggttcaactgcgggtaccactgattgaccagctaccggagttgccaacggggtgtgagatgacagcgactaccatgatgctgcagtatgccggtgttaatattaataaggaacagtttgccagccacgtgccgcgcagttcgaatcctaacactggttttgttggtgatcctgcttcggcttacggtattggtctctacatctacccccaaggcttgttaccaacgatccgccactatctgccgtccgctgtagatctcagcggggtgggcctgcaacgacttaaagcacagctcactaaacgtcatccggtagtcgcttgggttcagggactcgatggttttgcgagtcatacagtgacgctcactggatatacaacggcaactattaggtacaatgatccttggcgtggtcaatccggacagatggataaccaagcatttgagacgatgtggcaattaaatggtcgtcgggcactgagctattaagaaattgataccatagttaacattagttactgtttcataattttatattaaaaatacgctatttgacacacaaaataatcgtttttaatactgtatcacactagtgtatcaacttctagcctgaaataagggcttttagctttagtgtattttggcacggaatttgcatatatataagtgagtgcgaaaaagattgcgcttacagtatcaaaaacataaatagttacaggcaatttagatattatttattcgttttatatgactgtaacgaaaaaataggaggtacaaagatggtaagcattatcattgctagtcacggcgaattcgctaaaggcatctatcaatctggatcaatgattttcggcgaacaagaaaacgttcaagccgttacgttgatgcctagcgaaggccctgacgacatcaaggctaagttagaaaaagccattgcttcattcgacgatcaagagcaagtcttattcttagtcgacctttggggcggtacaccattcaatcaagttaacggcttgtttgaagcacacaaggacaaatgggcaatcgttgccggtttgaacttgccaatgttaattgaagcgtatgcttcacgactttcaatggattcggcacacgaaattgccacgcatatcattgaaactgctaaggatggggtaaaggttcgtcctgaagcattagcacctaaggaagaaaaggctgctgccgctgcaacgaccaacaataacgctggccggccagggaagttggaatatgggttagcacggattgactcgcgactcttgcatggacaagttgctactgcttggagtaagacagttaacccaactcggatcattgttgcgtctgataacgttgctaaagacgagctgcggactaacatgatcaagcaagcagcgccatctggtgtcaaagcgcacgttattccaattgctcaaatgattaagattgctaaagacgacaagcactttggtggtcaaaaggcgttggtcttattcgaaacaccacaagatgcattacgtgcaatcgagggtggtgtgccaattaagacattgaacattggttcgatggctcattcggctggtaaagttcaaccaaacaaggttttggcatttgatcaagatgatatcgacacttaccgtaaacttgaaaaagacggcatcgaatttgatgttcggaaggttccaagtgatggtaaagaaaatatggataacattttgaacaaagctgaaaatatgttgaaggaacaaaagtagttccaagaatatcagaaaagatggaggattaaatcatgaatttgaacgtaattcaagtgattttagtcgtacttgtatcatttttagctggtatggaaggtattttggatgaattccacttccatcaaccagttgttgcatgtaccctaatcggattagtaaccggacaattagtcccatgtattatcttaggtgggagtttacaaatgattgccttaggttgggccaacattggtgccgccgttgcacctgatgctgcgttagcatcaattgcatctgcaattattttagttttaggtggtcaaggccgtgccggagttacttcagctattgcgattgccgttcctttagccgttgctgggttactcttaacgatcatcgctcgtacgttagcaactgggattgtccacatcatggaccgggccgctgaagaaggtagttttagtaaaattgacttctggcaatgggttgcgatctgcatgcaaggacttcgtattgcgattccagccgctttgattttggccgttggtgctacgccagtgaaggcaatgttaaacgctatgcctagctggttaactgatggtttatcaatcggtggtggtatggttgttgccgttggttatgcaatggttatcaacatgatggcttctcgtgaagtttggccattcttcgctttaggttttgttttagctgcaatcagtgaaattactttgattggtttaggtgcaattggtatttccttagccttaatgtacttggcactttcaaagcaaggtaactctggcaatggtggtggctccaacacgggtgatccggttggcgacattatcgacaagtattagagaaggaggcaaactgagatgtctgaaactacaaatattactaaaaaagttacattaagtaaaagtgatcgtctgcatgtttggtggcgttcaacgttcctccaaggttcatggaactacgaacgtatgcaaaacggtggttgggcttattctttaattccagcaatcaagaaattatatacaactaaagaagaccgtgctgctgctttgaagcggcatctagaattcttcaacactcatccatacgtggcttcaccagttattggtgttaccttagcgcttgaagaagaacgtgccaatggggcacctattgatgacgttacgattcaaggggttaaagttggtatgatgggacctttagccggtgttggggacccagtgttctggtacacggttaagcctatcgttggtgccttagctgcatcattggctatttctggtagcattgttggaccaatcttatacttcgttgtttggaatgcaattcggatgggcttcatgtggtatacccaagaattcggttacaaagccggttctaagattactgatgacttatctggtggtattttgcaagatattacccgtggtgcttccatgttagggatgtttatcttagcggcgttaattgaacggtgggttaaggtggacttcagtccagttaaagtttcgaccattaagcaacaagctggttcgtacattgactgggataaactgcccaagggtgcttctggtgttaaggaagccttaacacagcaagctgctggtcgttcacttgacaaatacaaggtaaccaccttacaagataacttggatcaattgattcctggtttgatggcgttgctgttaaccttcctctgcatgtggttattaaagaagaaagtttcaccaatcattattattcttggcctcttcgtattgggggttctgttgcacgttattggttggatgtaatacttgcttatgtcatatttaaaggatggactcgtgggagctcatcctttttatttacaagcgtactttgcataactgacaaactcgccgtataatcggtatgaggatggatacgaggagggattaatatggtgcaatcaatcaatactaaggttgatttagttacgaacggcaattcacatatggggttgaccgattacggtaaaatcatggtcggtgataacggctttgaattttatgatgatcgcaatgttcgtaactttattcaaatcccttggactgaagtgaaatatgtggtcgtatccgtaatgtttggtggccgttggattccgcggttctcttttcaaacgaaacggaacggtatgattactttctcagctaaggaccctaagaaggtgctacgagccgttcggcaatatattgagcctgatcgaattgtaaaatcactgacatttttccaagtccttgggagaatattcaagggtaaaggtaaaaaagataagtatttgaaataatgaccaatgctgtcgagggttctttgccgacggattggtgattatttaatagttagtttaagaagcttaagtatcaacgggtggggttaacgcgggttgatacttaagcttttttaacgcatcaaaagcagtatccgagcacgttaaggtgcgtcataaatggaatttcaataccatgaaacagaaatagttgtactgacaagtcttaaaaagtaactgattcgggaactatggtagaatatagtgtgttatagtgtatcaaaacggatcagctatttgatagtggtgaaaaggagtggcgaagttgaccagaaaatccaagatttgtgaatacgtccgtcaacatagcgatcgacacggactgacgacggaaatggtagcgaccgctttaatgatagcgcgttcaaacgtcagcaaggaattaaatgcactggtacgagaaggccagctgcacaagctgacagggcggcctgtgcactatgttccggtgaatacgacagccacaacggccacaacaactagtggcgtagcgaatggggcgacgacagagcgaataccgacagcgcccgtcgcgacgtctgtgcctaaaccggttgtaaatgatatatttgccagcatgattggttcgcatgagagccttgctaatcaagtggaacaggcgaaagcggccattctttacccaccgcggggattgaatacattaatcattggcccgactggttctggtaaaacttactttgcaaacgccatgtatcgttttgcggaaacccaacaagtcttaacgaacccgcaaggcctgattacattcaattgtgccgattatgcgcataatccggaattattgatgtcgcatttgtttggttatgttaaggggtcttttacaggtgctaatgaagataaggacggtttgatccaagaagcggatgggggcatgttgttcctagatgaagtgcaccgtctaccaccagaaggtcaggaaatgattttttatttcatggatcacgggacttattcacgactcggtgagacggcgaagagtcaccatgccaatgtccgcttagtctgtgcaacgaccgaggacccagaaagtaccctactgcagacctttgttcggcgaattccgattacgattcagctaccagcgttcaatcatcgctcagccaaggaacgtttagaattactgaaggcattattgtcattggaagctaatcgaatcaataaacagattcggttaacggaggacgtggtgcaggccttacttggctcagtcacatttgggaacgtcggtcagttgaagtcgaacattcagctggtgtgtgcccagggttttgtcaatagcatcgaaaatgacagtgaaatcacaatcacgatggatgatttgccacagaatatccgtagcggtctcatgacagtagcctctaaccgtcacgaactgggggccatctctgagttgttggacccggttctcatcgtgaagccaaatgatggtccaacaccgcttcgtaataagaacgataattatgaattaccatataatttatatgagattattggtgataaagcagcgttactccgacgagaaggccttgataaagaacacatcaatcgtttcatcacgaccgatatcaatgtgcatttgaaatcattttataaacaaaatcagttagaagtttcaccagaaaacaagttagccgagatcgttgatcaggacgttattgattttaccaagacggcacagatgacggttcaagatatgctgggttataacttcaaggataactttatttacgctgtgagcttgcatgtcagttcctttatcaaacgcatccaggcaggcaagcccatgcgtcaaatgagttcggatatgttagcgatggtgcgtgaatatccggctgaaatcaaagcagcggaggcgctcaagcaaggattagaggaacggtatcatttaccgattcccaagtccgaagtttattatctggccattttgctcatctcgttaaaatcgatgcagcttaacggcaaagttggcgtgttggtggcagcgcacgggatgagtaccgcgtcttccatggcacaggtcgtcggacaattgttagatgattatgatgttcaggctttcgacatgcctctcgatatggacccgagtgtcgcctatgatcatgtcaagcgacgagtagaaaagcttgattctgggaaaggaattttgttactagtcgatatggggtcgttaacgaccttcggggaacgaattcagcaggagacaggaattgcgacgcgaacgattgacatggtgaccacgccggttgttttggaagccgttcggaaggctagcctggtcgatagtgatctggattctatgtatcaggagctcgttggtttcaaaggttattcgcgaatttcacggaacctaccaacggatagtcagcgcgcaacagtcaagcccgccttagcgacggataagacggcacaacgggcgattattgcaatttgtgcgaccggcgttgggacggctgaacgtatcaagtcaattttagacagtttattagctcaaaactttatcgaaggtattacggtattcccaatctcagtggtcgaaatgaagacacggatacaacaaatcagtcaaaattatcaaatcattgcggcaactgggattacaaaacccgaattagacgtcccttttatttcattggaagaattgctacaaggtggtggcgaaaagtttattgaccagttagcgacgggtatcgattcgccacagaccatggcggaagaaagtcagcagttgacaccggaactctgcgaacggtacttaggcgattacttcacgtttttaaatcctaagaagttaacgggaattttatgggagtatagcgaagtgattgcgacgcacttggatggtgtaatgacgaatgcttttcgcattgatttgattatgcacttagcgggtgcgctagaacgaacggccatcaaagatgaaatttcggcacccaccgaagagatgccagacattatggcatcgaagtggtacccacttgtgcaacaggccaatcagcaattgacagatcaactacagttaaccttctcagatgctgaaaattattatattgtgcaattattggagactcatcaggcaaaggtcgcgatgagttgatacactaacttggcatgctttttgcatgtatcttattgagtagatttaaccgactgaggagggaaagtagatgttagcatttgtcgttgtcagtcatgggagttttgcgcagggcgttgtcgattcatcctacatgatctttggcaagcaagataaggtccaaacggttacctttcaactagacgaagaacctaatgaattagctgataaattagctgctgcggttgcccggtttgacgcggatgatcaagttttattcttggttgacctatggggcggttcgccatttaacgccgctagtcggatcgttgccgaacatacagagcgcatgggtctgattaccggtctgaatctgccaatgctgattgaggcttacactgttcgtaataagccaattgatgaggtgattgcccaccttgaagagactggaaagattgggattaagcatctcaagttgttacaggacgatggggaagatgagccgctatgacgatggatattcgtttagcacgcattgatagtcggctactccacgggcaagttgccacggtgtggaccaagacggtcagtcctaaccgtattttggtcgtctcagacgaagttgcccaggatgcacttcgcaagattctaattgtgcaagccgcgccccctggtgtgaaagctaatgtgattacagttgacaaaatgatcgagatttatcaagactcgctatttgatgaagtaaagccactaatcctaactgatacgccccagaacatggcgcgcttagtagcggggggacttgattttagcaaaacgggcattgatattggtagtctagctttttcagcgggcatggtgatggtcaccaatgctattgcaatcggtcaagccgaagcacgggcattatatgcgttacaagcagcgggattaaaggtgtttgcgcagaaagtcccgacggataaacgggttgatgtgatgccgctattagctaaaaatggctttatggcgccagataagtattaacaaagttatgatggacagtggtgtgtcggttatgggcaccactgttctttcattttggctaggtttctaaggatttaccaaaaatacagccgtaaactttgacggataggcttttattgataaaattaaactaatcgaaacggaaagtagcgggggtttaaaaatgccaacttatacaaaattaaccgccatgggacaatatgttccgggacgcgttgttgataatgacgaattagcagccattatggacactagcgacgaatggattcaggcgcatactgggattaaaacccgacactacgcgatgaatgatgaaaacacctcggatttagccacccaggtcgcccagcagttactacaaaaaagtggtttagctgccagtgccattgatttgatcctagttacgacaattacgcccgatgccttaacacctgcgacggcttgtttagtgcaagctaatattggcgctgataatgcgtttgcgttcgacctgagtgcagcgtgtgctgggttcacgtttggcctagcaacggctgacaagtttattcgcagtgggcaataccaaaatgtgatggtgatcagtgcggaagttaattccaagatgatggactttcaagaccggacggcagccgtcttctttggggacggtgctggtggcgcgttattacaagctactgacaatccagatgaaaacagcttgatcgctgagaaattagaatcgcaaggaaacgctacggtcattcactctggacgagtacggccgattactgaagttgccgcaacgaactacccgcaaacggatgcgttttaccaagttggacgggatgtttttcaatttgccacgacggttgttccagaacagatgcgtgggttaattgcgagtgcgcaactgacacccagtgatttacaatacgtgatctgtcatcaagctaatttacggatcattgaaaaaattgcggctaacttggcgttaccaatgacgaagtttccacataatgttgatcattatggtaatacgtcctcagctggggtggcaatggccttagccaatgtttttgataccttaactgggccagtgctgttaacagcatttggtggcgggctagcatatggctcagtcttgatcaagaagtaggggtgtgcagatggaattaaaagatttagatcgattagttgagaaatacgcgcgacagggttatcagcaaattcgtgttaaagccggcgacttggagattgaagtgacaaaaccagcgttagcttcagaaacggtaactcccgtagccgctacgcctgccagcacagttgcggagactgaagatgaagtcgttacactgccgagtccgatggtcggggtggtccacttggcaccagatttaaaggttggtcagtcactgacagctggtcaagaactaggccagattgagagtatgaaattattcaatccattagttagtccgaccgatgggacgttaacagcagtactagttgctgacgacgccactgttgagtacgaacaaccgttatttacaatgcgaaaggatcggtagctatgtttcgcaagctgttaatcgcgaatcgcggtgaaattgccgtacggattatcaaagcctgtcaacaattgaatattcagacggtcgccgtttgctcaactgctgatcggcatgcgggttacacacaattagcggatgaagtggtctgtatcggacctgcagctgccagtggatcgtatttaaatgccgaagcgattctaatggctgcaattaatacgcacgccgatgcgattcacccgggatatggttttttagctgaaaatgcggattttgccgccatgtgtgcggaatgtggcattgcctggattggcccgcagactgagcaaattaagttgatgggtgataaggcccgtgctaaggattttgcacggcaacaagccgttccggtactagcaggtcaatcattacagggcttagcatggccggatattaaacacgcggccgccaagatcggttttccactagttttgaaagccagttatggtggcggtggcaagggtattcgagtgcttaccaacgttcatgaactccatcaacaattgcgggctgcgcgtcaagaagctgctgcgtcctttttgaatgatgcgatgtatttagagcaatttctgacaactgctcgccacattgaagttcaagtcctcggcacggggacgaaattattcattcttggtgatcgtgactgtagcctccaattgcacaagcaaaaggttctcgaagaaagtccggcaagtattttgactgagacacaacgccggaccttatacgatttgtcccggcagttattagcgggtacacattatcaaagtttgggcacaattgaatacttatttgcggatggtcagttctatttcatggaaatgaatacgcgtttacaggttgaacacggggtgacagaattaaccaccggaattgatattgtggctgaacaaatcaaacaggcggctggcgtcccggttgattttccagaacatgttggcttgcagcccaagtgtacggcgatcgaagctcggttgaccgcgaccttaccggttaagcagacgcggattgaaacgctgagctggccagccgatgtacgagtggatacggattatcatcagggcgatcggctagtaaccatgtatgatggtttgattgccaagttgatggtcaccggtgcgaaccgtcagcaaaccgtgcgcaacttacaacgggccttagcgcaagtaacattgacgggacccacgacgaacttaacttttctacagcaaacggtggcccggcccgcctacattcatgatcagtacacgattcacagtctagcacgttgggaggcgtcgaaatgagtcattatccagcttctgggacctggcaagcctgccctaagtgcggtcggcacgtccaccaacgccaatggggcacttatcagcaatgtccttattgtcactattggcaacgattgacgacggcgcaacgattagaacaactcgtcgatgaaggggcgtttcagccgttgacgatgactgagcggcctgtcaatcagctgggattcccggactatacgaacaaactgcggcgggctcaacgccagaccgggttaaacgaggctgttgtctgtggaacggccctgattgagcaacaaccctgtatcttagcagtgatggatagtcattttatgatggggacgttaaacacggcggtcacacgtcgcttattgcacgctagtgaacaggcgcgggcccaacggctaccactgatcattgtgaccgcctcaggtggtgctcggatgcaagaaggtgtttatgccttggtcggaatgaatttgattctggcagaattagcacggttagcagcaacgccgttacccttgatcacagtgctgacagatcccactatggggggcgtatcggcgagttttgcgtttaagggtgacctgattatcgcagaagcgggtgctaagattggctttgccggagcccgggtcattcaacaaactttgcctgtcaagctgccggcggattttcaaacggcggatcagctgtttaaaaatggcatggtggatgcagttgttgaacgacctcaattgcggtcaacgctaggacaagcattagcgaattatgggattgggaggtcagcccatggataaacgattacagcgattacagcgattacgggcggctgatcggatcagtgcgccgactatcattcaagcgttattgccgacaatgacgcaacaacggggagaccgtttattaggtcaggatgcggctttgacggcgggctttgggcgcactgctactggtcgccaattagctgttctgggcgttgaccggggtgttgatattgcgagccggcgtcgaaaaaacgggggggcattaactgttccaggctatcgcacggcgttaagagtcgtaacccatgcggctaaatttgggtggccggtcgttagcttaatcaatatgccaggtgctgatgcgagtccccaatcggaacgctatggtcagagtcaggccattgcggacttgattgcggtgactggtcagctgaccgtaccgaacgttgttgtatttctcggtgagggccatagcggtggggcgttagcctttgccaacgccaaccgcattatcatgctagatgatgcacttttcaacgttgcttctcccgaggcagttacagcgattttacatgggcaacaaactagcagtgacgccatcgatttattaccaatgacagctagcgctttgcagtcgcgcggcttagttgacctggttattgaccatcaggatcagacattagttgctgcgatcaaccaggcgattgagacccaacttaccgcactagaagcattgccgacaccggatctaattgaacagcgcgaaacaaagtttcaacactttttacaatcttggccggtcaattaaaaataatcatcaaaaaatgggtttctcagaatttttattctgaagaaacccattttttaatagttgcttagtactgattagttgtggtttgatcttgagtcgtggtctggtcctgcgtcgttgtatcttgtgtcgtactagtgccataagtagtggtatcactagacgttgtggtacttgatgaacttgaactggaacttgagctacccgttgtaattgaagctgtctcagagaagactgactctgttaaattactgtttgagagtcccagcgctttacggatgcgcttcgaattcttgtaacgttctgacgaagaggcaacttgataagagagcccatcgatcgtcgcgtcagtaccttgaacggtatatgatttggcatggtgagacgcattcttgtacttcgtatcgagtgcgaccatgtcattccaagttaagtcggtgcgcatgttcttagcgagttctttcgtaatcttttcaatattggcaattgacccaagtgagttagactgactaaccatggccataataacctgccgttgccgtttttgacgaccataatcaccctgaggatcgtcataacgcatccgtgagtaatcaagtgccgctgcaccattaagtttgatcttaacgcccttcttaacgttggcattaccgtatttgaaagtcagcttaggtgtcacggtcacgccgcccatcgcgttgatgatctgttttaaaccacccatgttcagtaagacgtagaagtcaattggaacatccagtaacttctccactgacttgacggcaccacttgcgcccccaatggtgtaggctgcgttaattttttgtgattgcccattgatcatcacttgcgtatcccgtggaatactagtgagcgtcatactttcttttttaggattgattgtcgcaacaatcatggtatcagtccgggccgagaagtccttgccgcgacctagtgcaccagtatcagttcccaacagtagaatcgagaatggcttgcccttcttaataacggcatcaacattccgaagcttggtcgagccggtcgactggtaggtcgtattcatcgtatccttagcggcattccaggtcttatagccccaccagccacccgtaacgatcaacaggacaacgacgattagtaaagtaattaaccaaggacgttttttgtgtggtttcaaatgtgggttacgctgttgctgttcacgatagcggcgttggcgtggtcccatttcattatcattgttattttctgacatattcgttcctcatcactttagatttttccctcaatagtcattttatgacgtttagcaaatcattggtccttaaagttagtaatttaaaaagattttaataatcaaaaaattactggcatcagtagtaacacaattatagaacactataagtaatattgtgaccggcgtcaaacgtttccatctataaattacggtacaagccatcataaaacagtggtatacttgaataattctcattgaattattattttacatagcttgatagcgatattcaatgatgagcaatttgttaagaggggaagactgagcgtgcaaattttacagacattcgtgcagagtattcaaggtgtcatgacgatcatcgtgatgattgcagttggttacttgttggcacgctggggctggtttaatgaaagtgcgactaagctgattgcccgattggtcactcaaattgcgctaccagcctacatgattgcaacgatcacaaagcagtttacagcgcataaattattatcaacgttgccaggattacgttttccagttcttaatatggctattttgtttggtatttcgttcggggtgatgcgagccttaaatattaaaaagagtcatcgcggcttatttgcctccatgtttttgaactccaatacggtgtttattgggctaccggttaatcaagccttgtttgggaatagcgcattaccatatgtgttagtttattacatggccaataccaccattttctggacgctgggcgtttacttgattcaacgtgacggtactggcaccgctaagtttgacttgaagcagacactgaccaagatcttctcaccgccattactaggatttatgattggtgtcttgcttgttctaggaaacattcacgttccaaaattcttgatggatgatttctcatatatcggcggtctaacgattccgctgtccatgatctttattgggatttcaatggccaacgccgggttaagcagcatgcgcttcgaccgggatagcttgggaattttacttgggcgttttatccttgcgccggtactgatgacgctgatgcttattccgatgtcgattccattggagatgaagcaagtcttcattctgcagtccgcgatgcctgtcatgacgaacgcgccagttgtctccaaactgtacggggcggatgccgattatgccgcggtcatggtgacagaaacgacactattgagcctaatcgttattccgattttgatggtgatcgttcaagccaactttattcgttaattattgtgtgatttaaaattaaaagtacccgaatgcgtgccactagtgacaggcgttgcgggtgcttttttgctggttgttaatgatgaaaactcaatttagttcggtcaacaaggtttgaccaattagatactttctgctcagggctgtcccaacacgtctcgctggtagtttttgatgacaagctgatgagtgcgtgctggatgatggttgaggcggcaagatgccattgaatggttccagcctgatgaaaattattttcaaaagcaattaaaaattgaaaaaataacgcctgattccgcgttaaacggcgttttcccgcggataaaagcgaggtaatatactgagctgatttgaaaatcacgtgaaaatggtgctatactgagaaccgttgcgtattaaattttgattaagaaggaagcgaacgtttcgtgaagaaagcatatctttacattgcaatttcgaccttaatgtttagttcgatggaaattgcgctaaagatggccggcagtgcctttaatccaatccaattgaatctaattcgattttttattggggcaattgtgttactgccatttgcattgcgggcattaaagcaaaccggacgaaagttagtgagtgctgactggcggctatttgctttaaccgggctagtgtgtgtcattgtcagtatgtcgctttaccaactcgcgattacggtcgatcaagcttcgactgtggccgtattgtttagaacgtgtttggatacttnnnnnnnnnnattctaaacacgttcttagttgtaatccggtatttgcgctattattctcctatttaattctgcgagaacggttgggtcgagctaacttgatctccgtcgtgatttctgtgattgggttgttgatcattgttaatccggcccatttgacgaatgggctcgggctgctattagccatcgggtctgccgtgacttttgggctgtacagtatcatctcgcgttatgggtctgttaaacggggcttgaatgggctgacgatgacttgttttactttctttgctggtgcgtttgaacttctagttttagcttggattactaagattccggctgtcgccaatgggttgacggccatcggtttgcggcaatttgctgccattccggttttggtgaatgttaatctcaactatttctggttactattttttatcggcgtttgtgttactggtgggggcttcgcgttttatttcttggcaatggaacaaaccgatgtttcaacggcttccctagtattcttcattaagccggggttggcgccaatcttagcagcgttaatcctccatgaacaaattttgtggacgacagtggtcggaattgttgtgattttgattggttccgtcgtgacctttgtcggtaatcggttccgtgaacgggatacgatgggtgcgattgagcagccaacagcggccgcctatgatgatgaacatgtcatcaaagccgcgcacgccgtttcaaatcaagaaaattaattaatcgtggacggtcagggtgatattaatcagcttgaccgtttttttgtggcaagcgcgttatcgcacgtaacagctggttgtgactttgaaaaatgaaccaaatcgattatcataggaagtattgaagatagtaggtgggaaagagaatgacagaactagtattggttcgccatggtgagagtacggccaatcgggataatacgtataccggttggagtgacgtcccgctaacagcagtgggtattgcacaggctcatcaagctggcaagcgattacgagctacgggactgcagtttggcgctgtgcatacctcagtcctaaaacgggctatcgttaccgcgaatattatgttaagtgaaattgatcagttatggctgcctgagtataagacgtggcggttaaatgaacgacattacggtgccttacgtggtcaaaataaggatgtgactcgtcaagagtacggtaaggcgcaagttcaacagtggcggcggagcttttatacggtgccgccgttgttgacaccagctgaactagaccatgatcgacgttacaccaagtacggtgccgccgtcgaaccgcggggagaaagcttgaagatggcttacgaccgcatcatgccttattggatcgatgagattgcaccgcggctgttagacggccaaaaccaactcgtggtggcgcatggtagtacgttgcgtgcgatgatcaaatatttagagcatattagtgatactgggattgatggtgtcgaagttgctaacggggtgccaatttgttatcaccttgatcagcaactgcacgttatcggtaaagaagagtattaaatttagtaatagttctcctaagcggtacttttattgaaagtaagtgctaatctggactgcttttttagaccattatcagattaatcgagcctgagttaagagcttcagcagacgctgaagctctttttttagttaaagtgttaaataaatgcccagtataagtaattataatcattgataataattgccgacgagtactcaaaaaatgatacaggcttaaaaaagttgatataacagtgctttcataactgtttgagttaatataaatatttttaatgtaatagaatccttcagttttcataaataaatataatatataacttgtaatagaatggtgaacgctgtaacatatcagatggacaaagttgcgatttggcgcgcttgacagccaaaaatctgatcagaaagccgggtaacgttatgatgaaacataaaaatttattattattaattataatgagcttgggtttctgcgggatgctgttgatgtttgcgccacaaatcagtacgctgatcaacccgaatgcgtcgcgagttgaagcggataaggctagtggtcacgatacgacgcatgatcaggtctactacaatgatcagatggataactatcaatatgattatataaataacgggactaaggttttgaactataaggcccgttttaagagtcgggtcatcacgtatcggatcacgagtgacagcaaggtgtatcgagcgatttggctacgagccgtggaacgttggaataacactaacgcggtgaggttagttgaggctaaggaccaagcgaaagcccagattacgttgggcgagagtgaagacgagacggagacgaccggatcggaaatcggccggacttggcggacgtactatcaaagtggttcgcaaggagcaacttggatggattcggcgaagtgtgtgatttacacgaatcgctttccagccagcaatcattcggtagaatataagctgtccgttgcgacccatgaattgggacatgcactgggactagagcacgagaacaacaagagtgcggtgatgtattaccagtcgcatcgagcagcacatatcacgactcgtgagattagtacgcttaagcagatgtataaataattataatagtgattgctataagtaaacgtaataataaaaaaatcgactaaactcacgcgagtttggtcgatttttttattgtttgttgttagtagttccttgagcggtagttaagtctaatgcagtccaaaaagcaccatcacgctaaagcagtgatggtgcttaatttagatggcccattaaacttaattaggctaatgcacccattggatcccaaggtgctaaaacagttggttcttcggcttgggctgcctttaagtcatcggacaagaattccttgttaacaacaacttggtagcagtattcgtccatccaagcatcgctcatgacgaagaagcccttagtcccaactttgtcgccccagctattttcaaccttccacttagttggttggccgtcaacgaggtcgacaccggtgataaccatggcgtgggtcatcagactttcgccgtaatcaagacgttcagccttcgacattgaaaggtcaacgtcgaataattcatctttactgtagacatcggtagccatgacccctttttggcggtcggaggattgaccaacatcacaaccaaaccagacactttggccagcttgtaattgcttgatggccaattgcttgaagtcggccatagacacgttcaaatgtttgacttcacggccacctaagacgttacctaacatttcaatcgtgtaggtatggttataaggcttgtcgtcggttggggcgttgatgattgaaacgtaatcgtccaaattccagccaacgtacttttcgaagaagctttgtggcgtcaagttttggtcgatgtggtattgtttcttatcatcacgatattcccagtcaaaatgtgaaacgggttcgccaaaggcataggctaacatgcgatagacttcatttaacattttttccttgcgttcttgaatcgcgtcgtcactagttccggcagccactagttcacgtaattcaacggcatctttacgtaattttaagttaagtgtgctgttgatttcagccgattttgaactgttgtaagtttcaggcatgacactcttaggcacgataccgtacttctgaataatggcaacgagcatatcccattggccaccatcttgttgtggcgtggtcatcaaccaggcaactttacggctgctagttggttggtcagcggttgccaacacgttttcatagaaatagttcgctttttcgaacttatcccagaaaaaggtgtagttttgtgatagttcgaaatgtttcaagttgaatttttcagctaatgaatgccgcatcgtgtttaaagcggcgaacatccagcaacggccactttgcttttggttcgcaacgtcacctgtatccaaatcaatggaaaatactggtgtggtttggctcatggcctgaatatcttgactgcttgctaagataccgttcttagtgacactacgttcgatgacttttgcttcgggacgttggtccaagtcggcttgaaagttagcaatttggttcatactgattgctttactcaaaagatcactctcctttaatctaattctaattgtatcggtttatgacgggtggggcaagcggggagtcgcacaaaactatggtcgcgcttcgataacctcgggaccattggcatgaccgacaatgacagtgttgaccatgtctaagaacaggccgtgttcaaccacaccaaccatgtgaattaaatcttcggctaaagcgtggggatccgtgattgggtcgatgtgtaaatcgatgataatattattagaatcggtccggacgagttcatcgttgactttacggaatactgggttatagccccgggtagccattttttcaaagacatgttggctgccgtaaggaatcacttcaacgggtaagccaaaggcacctaattgatggaccattttgctttcatcaacaatccacatgactttatcagaattgatggcaacgattttttcgaagagtaaggcggcgccaccacccttaacgccttggaaatcatcggcgatttcgtcggcaccgtcgatcgttaagtcgagatggtcgacttcgtcaacggatttcatcgggataccgagcgccttagcttgggcagcggttcggtcggaggttgagacgccgacaatgtttaaatgttcatttttgacccgttcacccagagcatcaaccatgaatttaacggttgagccggttccgaggccgacctgcatgccgtcttgaatgtattcaacggctttttgaccaacaagttgttttaactgatcctgattcataatatgaattactcctttgattgagaactagtgactaatacgtcggcagcttcagggtgccgatcaaagtaagccttagcgtaggtacacagtggctgaatacgtttgtgttcaactcgagcggcgtcaataacggctttggttaattggccggcaatgccctgatgaccaaaatcgtcacgaacaaaggtatgttcaatgacccaggtctgatcattattgatggcggggaaggtaatttcaccagccaacttgccgtgatcgtcattaaaataaaagcggtgtgcttcacgcgtgaattccattgatttcaccaccttgtaaagggttttatatctaccgtaattaaaccggtaattgcccgttttgtcaacgaaacttctataataaaagtatggtaaaatgtgaacactaaattaatgttgagaaagtaggaatttgaaatggcacggggatttgaaattgtaagtcaatacgcgcaggcggggttacatgtaccttaccgcactaccaagcaagcagctggctatgacttcgaagcggcggaagattttacgttaccgtcaatttggaaaatgaactttatcaaagtactttggcaaatacatcatggtgaaacgagttctgcagccgatttggatgcggcggctaaagtccttaaaccatggcttgttccaacgggtattaaggcatttatgaatgatggtgaatacttactattagccaatcgttctagcaaccccttgaagcgtaacttgattctaccgaatgggattggcgtcattgacgctgactactataacaatcccaagaacgaaggtgcgattttcgtccaattaatcaacatggggattcgcgacgttcacattaaaaagggtgaacgcattgcccaagggatttttaccccttatctgactgttacggatgaaacgaatgtgacaacgacacgttctgggggcttcggttcgaccaataaataggaaataataaaaaatcggtaaagccaaggtgatttaaaggctttaatgattaataatggtaaaataaacttatacccatagcatgaaaatgacgatccagttaattgagtttgattgattatttaagtctgcatcgtactggctggttgtttagtaagaatcatggttaaaaggtgccaattagatagatttctgttcgtctgcaatgactatcctattccgacctccgggactgggtgacaattgctggaacgtaagccgacgtcgatttgagctaacgcataacccgcgtcatctcaaatacgagtcttattctaagccggaagaaagacacttccggctaagaataatttggctactgagcattgtcacccagcccctccagtcgggaagccgctcgaatggcaaataaacggccgcttaacttggtacaattggttgctgactactttgatacgaaaactttgagcgaaacatcagaatgtaatctctactttgtcgaaacgttcaatgtattatgactggtaactcagaaatagtaagtcatcacaatatcattttcggcctgacagttgattgagaaaattaccgtttatgaaaaacaacgaccaattcatcaaaagttgagtacatcttcatcagctattcgaataccatcccgactggaaggtgtttctgacaatgcccagtactgcaagagtgtgaagtctcagtctgacccgaacacgtttcaccaatatggcataaaagcgtgaaaggccagtatttaagacgtgggcttcggctcaaatctgtgcccaccgcgttccggcaattggcagaaannnnnnnnnngcaattggcagaaatgcctggaggtcggtgtaggacgaattaactaagcaagtttacgctaacccggactgtttccagcgggcctaagctggctgcttttaaatttaaaaaacggcacgttttaatcatgactcatgacagtgtgacgcggatgaagtaattattttagaaatcccaatacccaacattaaattgatatgttggcggagaaatggagacgtgtgtacgtggcaaaagcaaaaactcagtttgtttgttctaactgtggttattcaacaccgcgatatttaggacggtgtccgaactgtggtgaatggaatacactaactgaagaacattttgatacaaaaccggaccgcaagtcgcgggtgagctttgcgggtaagtcggctaagccacaacgactcaaagaagtgtcgctgactaagacaccgcgtgtcaagactaagctgaaagagttcaaccgggtcttaggtggcggtgttgtgccaggttcactagttttgatcggtggtgatccaggtattggtaagtcaacgttactactgcaagtttcggggcaattggccgagacgggtggttccgtactatacgtgactggtgaagaaagtgcctcccaagtgaagatgcgggcggaccggctggctgttagcagtgaagacttttatctttatcctgagactgatatgtcgaatattcgttcaacgattgaatcgacgcatccagaatttgtggtcattgattcggtacaaacgatgcaagaacctgatatggactctgcgattggttcagtatcacaaatccgtgaaattacggctgaactactgcaaattgcgaagactaacggcattaccatttttattgtgggccatgtgactaagggtggtgccattgcggggcctaagatcttagaacatatggttgataccgttttgtactttgaaggtgatttacatcatacgtaccgcattttacgggcagtcaagaatcgattcgggtcaacgaatgaactgggaatatttgagatgcggacgggcggtttgtatgaagtggccaatccgtcagagatcttcttggaagaacgtctgaaggatgctacgggttccgccatcgttgtttcaatggaaggaacacgaccaatcttagtagaagttcaagcgctggtaacgccaacggtctttggtaatgcgaagcggaccgcaagtggcttggatcataatcgagtctccttgattatggcagtgttggaaaaacgggcgagtctaatgcttcagaaccaggacgcgtatttgaaagcggccggtggcgttaagttagatgaaccggcgattgacttagctattgcggtcagtgtggcttctagttatcgtgaccagcagactcgtccgagtgactgttttgttggtgaagtcggtttgactggtgagattcggcgggtcaaccggattgaatcacgagttggtgaggcggctaagctaggttttaaacgtatctttattcctaagaataatctgcaaggttgggatatcccaactggaatcgaagtaattggagttgccacgctaaaagaagcgctccaattagcattacaacaaccaaattattaaaaaggggctgatgccatgaagaagttaacggtgcgactagtatttattgtcgtcgggggtacgttaggactaacttacctgccgttcttgtggacgacaattttgtcgcaaccaaatgtgttattgaataacgtttttaccaactttttgttgggggcgctgattctatgggttttgtcattgttcttagccaatgccgctgtacgactggtggatcgagtcgaaaagaacttatccaagcaaaatccaatgacacttttatttggcagtatcggatttattattgggttattgatcgcggttctgatttcgcaattatttaatcgtagtccattattcctattgaacacggtcgtcccaattattttgatgttgttttttggttacattggtgcgcgagtcgggactacccggatcgacgagtggcggaaagttttcaacttccgccgtcgtgaaaaggaaacaagtccggagattactgatgctcagccagatcagaactatcatcattataagattctagataccaacatcttgattgacggccggatttacgacattgtcaagactggtttcttagaaggaacactgttagtaccgaacttcgtcttgtatgaattacagtacattgcggattcagctgatagtattaaacgtgtgcggggtcgtcgcgggctagatattttaaataagctacaaaatgaaaatattatcccggttgaaatgtacgagggcgattttgaggatattccagaagttgatagtaaactcattcaattggctaaaaaagtcaacggtgtgatcgtgacgaatgactacaacttgaataaggtgattgagttccaaaacgtacaagtcctcaatattaatcagttggctaagtcgttgaaaccacgggttattcctggtgaagagatgaatgtcatggtcgtcaaaaatggtagcgaacgccaacaaggggtcggttacttggacgatgggacgatggttgtcgtcgaagatgggaagttttacatcaatgaaaaggtggatgtcgttgtaacgagcgccttacaaacggatgctggtcgaatgatttttgcccgtttagcacacgctaatcgcggaatcccggatcatgcggatggaaataataagcacaacaataatcatagtaataatcgaaataataatcgcgataatcggcactaggaagcgattcaacggtagcaactcatttgatgggggctaccgtttttttgttcaatgatgactaatccaggacgtcgtaagggaggcgccgaatcgcaacaaaataggagggttaatgctcattatcaataaattgggatgttgttagtgtacgattagggcctgtttcgatatttttacaatgggttcagtctgaaaccttaatttttagcggtaaacatggtaaactggaaaagcaagtgaaagtcggaatattctggtcgatagaaaggttccggcgtaacatttaagatgaaaaaatacgaaagaggcgttaatcacattggcaaagagcaagattcgtgtgcgttacgcaccaagtccaactggccatttacacattggtaatgctcggactgcattgtttaactatttatttgcccggcataataagggaaagttcattcttcggattgaagacaccgatttaaagcggaatgttaaagacggtgaaaagagtcagatggacaatttgacgtggttagggattgattgggacgaaggtccggataagggtggcgactttggcccttaccgtcaatcagaacggaaatcaatctatgacccgttgattcaacaattaattgatgaaggtaaagcttacgaatcttacatgacggaagacgaattgtcggcacaacgtgaagctcaaaaagcgcgtaaggaaatgccacactacgtctacgaatttgctggcatgacggaagacgaaaaacaggcgaagatcgcggctgctaaggcggctggtatccaacccgttattcgcttccacgtcccagaaaatacgacctatgcttgggatgacatggttaaaggtaaagtttcgtttgaatccaagacggttggtggcgactttgtcatcaagaagcgtgacgggatgccaacgtacaactttgcggtggttgttgatgaccatatgatggaaattagccacgtcttccgtggtgatgaccacgttgccaacacgcctaagcaattgatgatttatgaagcctttggttggcaaccaccgaagtttggccacatgagcttaattatcaataccgaaaccggtaagaagttaagcaagcgtgacgaaaccgtattgcaatttatcgaacaataccgtgaattgggttacttaccagaagcaatgcttaacttcatcatcctactaggatggtcaccagttggcgaaagtgaattgttcagtaagcgcgaattcatcaaaatgtatgatgaaaagcggttgagcaagtcaccagcagcttttgatggcaagaagttggaatgggtgaacaaccagtacattaagaaggctgacgaaaatgaagtctttgcaatgtcaattcgccaattgatcaaggctggccggttaccacaacgcccagatatgagccagattgaatggtcacggacgttggtttcattatttaagaaccagatgagctatactggtcaaatcgttgatttagcagatctcttcttcaatggtccggctgatatcaatgatgaagctaaggccgaacttgataatgacacggcactccctgtcttgaaggaattccggcaacgaatcgaagatattgacgtcttcgaagcaaccgcaattcaaaagacgatcaagagcattcaaaaggatacgaagatcaagggccgggcattatacatgccgatccggatcgccgtttctcacgaaatgcacgggccagaattaccagaaacgattgaattattagggcgtgaaacgaccaaaaagcatctcgatgctatgattgcggaactcgccaagtaatgaatggattattaaaatattagttggttgtcgtaagtggcggtcgtcgtcagcaagacaacgcaattaatacatcgtgcggtcagcaagctagtccccgggtgagcgttatctcagtatcgcgaaagttacccagtggcgcgtgactgcatatgaaagtatcttttgtatggtggagtttcggttccaccgtgcgagggatgctttttatttgtgtttcaaacatggtaaactatcatcaaaagtaatgattcaattgaaaggagttgtcgccaatatgttaagtgtttttaatacgttaacgcgtcaaaaagaaccgttcaagcccatcacccccggagttgtgaaaatgtatgtctgtgggccgaccgtttataactatattcatatcggtaatgcgcgttctgcaattgcctttgatactatccgacggtattttgaatattgcggttaccacgttgactatgtctccaacttcacggatgtggatgataagctgatcaaacgtgccgctgaagatcacaccacggtaccagcagttgctgaccggtttattaaagcttttatggaagatacgactgcggtcaatattgaaccagcgacggttcacccgcgggcctctgagaatatcccagaaatcattgcatttgtacaagcattgattgaaaagggctatgcttacgaatcagctggcgacgtatattaccgcgcacggaagtttaaaaagtatggtcagttatctgaccagcgaatcgatgatttagaagtgggtgccagtcagcatactgccgatgaagaaaccgatcgtaaagaagatccaattgactttgcactctggaaagcagccaagcccggtgaaatttcatgggaatcgccatggggtgcgggtcggcccggctggcatattgaatgctcggtcatgtctactaagtacttgggcgatacgtttgatattcatggtggtggtcaggaccttgaattcccacatcatgaaaatgaaattgcccagagtgaagcgaagaccggcaagacgtttgccaattattggttacacaacggttttgtgacggttggcgatgacaacgaaaagatgagtaagtcattaggtaattttgtgacggttcacgatattattaaaacggttgatccgcaagtgctacggttcttcatggcgacgacccagtaccggcgaccgattcaatatacgcaggccaacttagacgaagcagctaataacttggataagttacgtaatgcttatcgtaatctcacgttccggttgcaagatgcgacgaacgggacggatactgcggtggcagaacagttacagacactcatcactaactttggaaccgcaatggatgacgatttcaatgttcaaaacggggtggctgctgtgtatgaattagctaagttagccaatgtctatgcagccaaggcaacggttcaaaaagagacgttgattgccttacagaaggcattagtgcagttgactggcgtcttcggcgtcacttttgaaacggctaatgcgacgctggctgatgacgcgattcaagcactgatcgatgaacgagaagctgctcgtaaagctaaggattttgctaaggccgaccagattcgtgatgatttgaaagctcaggggattattttagaagatacgcctcagggtgtgcggtttagaaaggaataatatgcaagttgattatcaacaattaaacgggattgcactcgcgtacctcggtgacgcggtgtatgaaccgtttattcgccaacatttgattgaaagtggttttactaaagccactaagttgcaccaccacgcaacccactatgtttcagccaaagcgcaagcggcactgatcgaacggatgcaggccgaagaagttttaacgccaactgaagtggacgtttttaagcgtggacggaatgccaagagtcatacgtcggccaaacataccgatgtcgtcacttaccggatctcaaccggttttgaagccgtttttgggtatttacaattgactcagcaggcggaccgaattgcagaactggcacagtggtgtattaaacaagttgatgaagggagggtttccagtgtcaaataatgaacaagaccaaacagcagctgactttgtaattgggcggcaccccgccatggcagcaatcaagagtgatcaacagatcaacaaagtctttattcaaagcggtctacaggccgatgtactgaatgacattgccaagattgcgaagaaacgtaatttgatcgtacagtacgtgccgaaacaaaagttagaccgtttaaccgacaacgccaaccatcagggggtagctgtgggggtggctgcttttgaatatgccaccattgatgatttatttgctgttgctaaggctaagaatgaagcgccatttttcttgatcttggataatatcgaagatccccataacttaggttcgattatgcggacggccgatgcagctggcgcccatggcatcattattccgaaacggcgcgccgtggggttaaccagtacggttgccaagacgtcaacgggggctatcgaacacgtgaaagttgcgcgggtgacgaacttggttcaaacggttaaacaattgcaagaagccggtctgtggatctttgggactgatatgaatgggacggactaccgacagtgggatgcttccggtgccgttggtttgattattggtaatgaaggtaagggaatttcaccattacttaagaagagtgtggacgaaatgttgaccattccaatgattggtcatgttcaaagtttgaatgccagtgtggcggccagccttctgatttatcaaggctacacgtcccggcatccactgggaaaataagatgaaacaacaattattgattgtcgatgcttacaatatgattggcaactggccagaactcaatcatttaaaacaaacggaccggttgccgcaagctcgtgacgagttaattagcatgttgactgagtataaaaaaattacgggccttaatattagcctggtttttgatgcgatgtacgttccgggtaattctaagagttatcgccaagctgatcttgagattatttggacgagtaaagaccagaccgctgacagttatatcgaaaagtacgcgggtgaaaagcaatcgcgagtacttcaagtgacggttgcgactagtgatcaggcagaacaatgggtaatctttttggaaggtgcattacgagtaccagccttggaattacgacaccgcgtcaagactgcgctgaaagatgtgcgtcatactgccgtgcgcacccaggatttaggtgccgttcgtaaatcaccctggaatgatgatcaattatcggccttggatcagtaccgccaacaactagaacgcaatcacgttaaacatcatcacaggtcgtaattaggtggttgccgcgagcgtgggctgtttctaaatcgtcataattaatatttaaattttgcaaaagataaccagtggcaatttaaggctcgaaagcagttctagtattaaaatatctagtaatcaaatgccccagttcagctgctgttcactagatgttaggatggcttgtcataacagttttagtgttatcggagtttgcgctggcgattgcattaatcggttggttagacagcgtagtggcttcgtgcaactccagcggacgcgcgtactcgtctccaacgggcttaagtaggtcgcacttgtctttggcgttagcaatattttgatattactaataattagtgcgatatagcactattaggttgatgaatgggacgatcatagtagttttgatagccgcgtataagaagatttctgtgagtgctgaggtggctgaattgaaacgttcgttcgcttgtgacggcacaattaacccggtatattagcattacagatgctcaggggtgcagtttctgaaactagtcagaagcgaggaatgtcacgtgaatgaacagcaattgatccacttagcagcagatggtgatgatgcaagcattaatgcattagcccagcagtatgtcccagttgtttggcggttgcgacggcaatactatgtccggaactttgacgaggatgattggcttcaagaaggtcgaattgcagtttatcgagcggctaaaaagtatcaacggctacggcaatgtagctttggcacttattaccgggtgctattgagtaatcagattattgatcatattcggcggacacaggctcgcaagcgtcgtccggaaggggatatcttatcgctggatgttaatgatgaggatatcttatgcaatattcagacgctaagggcctcgacccttgatgtggttcatgttcgtgagcaggtgcggatttttccagcaatctgttcggcatttgaaggattggtttttatggatctattggcagggcaatcgccagaacggattgcattgagtcggcaagtggaagttgatcaagtggtcaacgccacggatcgatgccgcaagaagatgcgtgactttttacaagacgctgcctgaaattgacattcgaaaagttccatgctaatgttatacctgatttattatggaggttttgtcgatggcacagaaaaaagttgcactggcatgtaccgtttgtggttcgcggaactacacgattgatgctaacccgaatcgaactgaccgcttagaagttaagaaattttgtaaatattgtggtaaacacacacttcatcgtgaaacgcggtagggggattagacatgcgcttatttaaattttttggtcaagttggacatgaaatgaaaaaagtgacctggccaacttggcgggaaaatcgtcgtgattcgtggacagttgtctcaacatcactgttcttcgtggcgtttttcgctttatttgattggattatccaattattattacaaatgttaacaagctggcattaatggctttttgaacaaatttttgttataataatggcattgaaagaaaacttcgtgcaaacgaggtttttttattttgccaaaagacattttaaaggagaataataatggtcgagtctgttgagaaaagatggtatgtcttacatacctacgctggttatgaaaataaggttagttctaacttggaatcccgtattcaatctatgggaatggaagacaatattttccgggtcgttgttcccgaagaagaagctcatgaagtcaagaatgggaaagacaaagttgaaatgaagaagatcttccctggttacgttttggttgaaatggtcatgacggaccaagcttggtatattgttcggaatacgccaggtgttactgggttcttaggatcacatgggcaaggtagtaaaccaacgccattgttgcctgaagaagcggaacaaatcttgcatcaactaggcatgagtgctcggcataccgaattggacgttgaagttggcgaacaagttaccatcatcgatggcgctttctctggcctttctggtgaaattactgaaattgacaacgaaaagatgaagctcaaggttaatatcaatatgttcggtcgggaaacaagtactgaattggacttcgatcaagttgaccagattcggtaattaatttaagtaagctggtggaccatcttggcagaagtaattttagtcatcatcggcgccttagtgctcggtattttggggcgtatcacctttaaattttggcaatacgggcgaccgcagcatttgcggcagtcggtgtcggctaattcagcagatgatagcgccgtgacgctatttattccagggtatgcgggcaaccggttctcttttggtggcatgctccaacgttttacggccgggggcatcgccaataagtcattagtcgtaatgattgatcgacataatcatccccatgtgactggtgagctagacgcttaccgcccaatggtacagttgatttttgccacgccacgcgttgctgtacggcaacaggcggcgggcgtcttggcagttgtgcagtatttgattgcgcatgagcacgttcagacgatcaatttagtcgctcattcgatgggtggtgtggtgctctttcaatacttgacgacagctgccaaactggtcaatttaccggaagtccgcaaggttgtcacaattggtgcgccgtttaatgatagtgaggtcgggcaaaatacgtatccgattgaaaaccacccgttgacggcgaccggaccaactaagactacgcccgtttataattattttttgcgaacgctccaacgattgccaaacacgatttcgtatttgaatattgcgggtaacattggcgatgcggcgcaaagtgatggtgctgtcgctctgaatagtgcgttgtcattgcgctttttactgcgaccaacgcgtgaccagtatcaagaatttgtggtacatggtaagaatgcccgccattcacgattacatgaaaactatgaagttgatcgccaaatcgtccagtttttatatccagaagctacaaaaaaggttgctggtgaaaaatagatatgctacaatgatgtttgtgcgtcacgtatgcacgtttacgtgggaggagcaaaaactcagctccatttaccacatcacggactaaggaggaatgtctcgtggctaaaaaagtagctaacgttgttaaattacaaattcctgcgggcaaagcaacacctgctccgccagttggcccagctttaggtcaagcaggtatcaatatcatgggtttcacaaaggatttcaatgctcgtactgctgatcaagcaggtatgatcatccctgttgtgattacggtgtacgaagatcgttcattcgacttcatcactaagaccccacctgctgccgttctattgaagaaagctgccggtgttgaaagtggttccggtgaacctaacacgaagaaggttgcaactgtaaccaaagatcaagttaagcaaatcgccgaaactaaaatgcaagatctaaacgcagctgacgttgaagcagctatgcgcatgatcgaaggtactgctcggagtatgggattcaccgtcgaaggctaattcagtactgttgagtatgtcggacacttcatcaaaatgaatgtgtcaagtgggaggaaatctccgtttgaaccacatttgcaaggaggaaaacacttagatggcaaagaaaagtaaacaataccaagacgccgctaagctcgttgatcgtgacaaagcttacgatgtaactgaagcggtagacttggttaaaaaaatggatttcgcaaagtttgatgcaactgttgaagttgccttcaaattaaacgttgatacaaagcaagccgaccaacaacttcgtggcgcggttgtccttcctaatggtaccggtaaagatcaaaccgttatcgtttttgctaagggtgacaaggctaaagaagctgaagaagccggtgctgactttgttggtgaaactgatttagttcagaagatccaagacggttggttagactttgatgtcgcaatcgctacccctgacatgatggcccaagttggtcgtttaggtcgggttcttggacctaaaggcttaatgcctaaccctaagactggtacggttacgatggacgttgctaaagccgttaacgattcaaaagctggtaaggtgacttaccggactgaccgtgacggtaacgttcacgttcctgttggcaaggtatcattcgatactgacaagttagttggtaacttcaagaccattgaagacaccatcgtgaaagctcgtccagcctcagtacgtgggactttcatccaaaacttagttgttacttcaacctttaccccagcggtacgtgttgatttagcatcattttaaggattaaattctgaaaacaattgaccccgtgggtgatctgtgatagattactagaggttaagtaatatctctacctaagactcaggcggcttaacggccttaatctacctgccgaggacattgttttttctctatgtcttggtggacatagggatttttttataaatccctgaaccaaaattctgggaggtgaatctgttgagtaaagaaacaattgctgttaaagcacaagaagtcgaagaagttgcagaacaattgaagagctcagtatcagccattgttgttgattaccgtggtttgactgttgaacaagtaactgatttacgtaagcaattacgtgaagccggtgttaagatgcgcgttatcaagaacaagatcatggtgcgtgccgctgataaggccggatttgaagacttaaaacctgtatttgctggtcctactgccgttgccttctctgaagaagacccagttgctcctgcaaagatcttggctaacttcgcgaagaccgctgatgcccttcaattaaagggtggcgtgatcgaaggtaaagttgctgatcttgaaactgttcaagaatacgctacgatgccatcacgtgaagaattattggctacgatcgccaacttgttacaagcacctgttcgtaacgttgcatacgctgttaaggcggttgctgaaaaaggcgacgaagacgcagcttaatttgctgtcagtgtgttaaaaaaactaaaatataagttcatataaaatggaggaacaaaaaatggcttttgataaagatgctattatcgactcattaaaagaagcttcaatctcagatttaaacgacttagttaaggctatcgaagaagaattcgatgtctcagcttcagcccctgttgctgttgccggtgctgctggtggcgacgctgccgctgctaaggattcatacgatgttgaattaactgaatccggtgaccaaaaggttaaggctattaaggccgttcgtgatatcactggtcttggcttgaaagatgctaagggtcttgttgataacgtaccttcaatcatcaaagaaggcgtttcagaagacgaagccaacgatatgaaagctaagcttgaagaagttggtggtgtcgttacccttaagtaattatttacttaacggaacgtcatcagaccacaccctactatggggtgtggtttttttttatctctagatgtggcgttggtgcgaatcacgtgcatgaccacgcatataacgattactgagaatttatacttaggctaagtgttagtgcaatttgatatcaaccaccgtatgattacggtgacttggcgttagaggcgtaaccgtattggattaagcaagtcaaaacaagcccaacagaacgtcgcatagtacgtctgttgggcttgttttaaaatttcacttgggttgaacttctggtcgacagggcactatcacttttgtggctgctgcgtgataggctgaatacgatgatcaatgatcgttagtgactgacctgactagtgccatcagtatagttcaaggtcataccgggctggatattgaaaatatagacattaaaactaacagtattgctaccaactgactgaccacgcatttgaacaccgcgggctaacaattcgttacctttgaaaatgggggtcacttggtagcggacgtagtttttcggactttctttcaaataggccgcaacttggttttcataggtcgtcatttcagggtcattcaaagaacgggttccggtcatgaggttcttgatattgttgttctgccccgttaattgatagccaatcagatgactgcggttgtaaagccaaccgctactgatgcgtttgttatgccaaccagttggtcgaacattcaaggcctcacgttcagctttgggcatcagtgactgatttaagagggcattagcagccgtcacccggttaagtgagtctaaattgccatattgttgccaggcaccctgactcgtactgagctccttagcggtaaatgcgggctgattctgattaatcgtgatcgtttgttgaccgttgtaagttttactagccaacgcattgttacttgggttatggtcagaattgaccttggttggtgctgttgtcgaagttgcgccagcttgcttgttcgtagccttgagcttgtcaatatgttgttgactactcgaaagttttttcgcagcctgctttaagctgctagcagaagcacgattggcagcttgaagtgccgtcagttgcttgtcattattagccgttactaagtgggtcttagtaacggtctttgtcttcacagttggctgagtggattcatcagatgtgccgagaatactaaagctgacgagcaatgcgataatggccggccaactatgccgccaccattgacgcccacggtagcgccgatgtaagcgccagaaccagtacagggttgcaaataataagatggtgccgatcaatgccatgaagtgatcctcctatcgaaatgacttacggaaaccagcggcccgcgccgcgtcttccgtactaaagtaaacggcatttttaccggccatccggtagttttgccccgtttcaacgtgataaattttggaattgcggttacctacgatacgtccagtttgggcggtatcggtatcgccagaaaaattattctgccgactcgtggttgcggtactagtttgagtttgttgactttgagaagctgcttgactgctggctttggccgcttgcttagattggctaaccgccgcgacggccgaagcggactgggcttctgactgggagcgtgattgtgcggtcgcttcactagcagctgatttggcggcagcctgtgacgctgattttgatgaggccattgcgtcgtcatgttttgcttttagttgttcggattgacgcttagcctgactagttgcaattgcgagttgggtcgtgtttgaactaagagctttggctgaggccgcgttagcccgactagcggcccttgcttttgcccaggcggctttattagcagcagtccgtttctcaacccgaaccgtcttggttttgacactggtatggttggcggcttgttgattaccagtggtacagccggttaagatgagtagactcgttagtgcaacgacgagtttttttgcatggtgcataagaaattcctccttgtttatgtatcactttaattatacataaacggtaaaggttggtaaagcgagtttggcaactaaaaatcaattaatattggtttatgctggtattaatttcgatgattaatcataattagtgctaactactaacacccattcggaacaatttagtaacaggtatttaaaatgttcatagcttaatacggcgacaaatcagacctgtgggggttattaacgacctataacggttgtataaacaggctaagattgcgataatagaacaaacacaccaatgggggaatttttttgaaggcaacgttacagaaaatcgggacggcactcaataaacgcatggggattatcaaagcattatttgtattctctgtcctgttatttgtgattacggaagtcggcaaaattgcgaaggaagtcagtggcgcgcagttggcgaatgcgcttgcttcgcaaagctggtggcatctgttaagcatggtcgtgattggtattatcgcagtgacaccaatgctgacgtatgacgtcatgattacaaagtttttacccaaccactattcacttggctatatcttaaaagctggatggatcaccaatacatttacgaatatcggtggttttgggggcgtgctgggcgcctcactgcgtgctaacttttataatcgcgaagccactaagaaacaaatcgtgtttgccatttccaagatcgctttgtttttagtttcgggattgtcattatattgtatgatttcactcgtgctagtctatggctttggcattgggaacatgtatggcagttactggatctggctcgtcggtggtgcactgtattttccagccatctttatttttacacgagtcaacgattcggaattcttcgatggccttacgctcggcaacgtcgttcggttattgagtgggtcgtttggtgaatggactggctgtgtgctgttcttcttattaattggaaactttatgggattacccattgattttgcagcggtcgtgccgttattcgtgattgcttcggttgtcggtgaagtgtcaatggtacccggtggtattgggtcattcgacgttttcatgatttttggcctcggtgcggtcggagtttctcgaccagacgcagtcgcatggctcttattttaccggttattctactatattatcccgtttgccatcgggttggtcttattcatccatgacaccggccatcgcttaaacgtgcgcttagcgggtattcctaagcaggcattacaacgtgttgctcagatggtactgacggtttttctctacttttctggttttttgatgttgttgatgtcaacggtccctaactttgcatataacaataaactcttcttacagttttatccgtacacctttttctttattaatcaggccagcagtattattatggccttcttactgattggggtggcgttgggaactgctggccgggtcaaaaaagctttttggccaacggtgattgtcctgctgattgcaattttgaatacgattcgctggctcgtcgtctatgatgcaatttcgatgaaatttgtgattttcttgattgtgattctagcgctagtggctttgtcgcggcatgcttattatcgtgatcggttggctttttcgtgggggcaaacgttgtgggttagctgcgtgtatgtggtgacctttatcttgtatacgattgtgggggtctataacgcaccccaaattcatcatcggcatgcggttcctgaagctctgttcttcccatcacaaaagctctggttatttggggtgattgggttagtcttagcggcaatgattttgattattatgtaccgctactttgcgagtggctataacgcccgattgcgtcaaaagatggatgcggctcgggtcaaacaagtgattgaaacttatggtggcaatgaaatctcacacttggcttatttgaatgataagttagcatattactatcaagtcgatggggtcgatcaactgattttcttataccaacagaaggccgataaactgattattatgggagagccattcggtaatcaagcggtattacaagctgccttggaacagttattggatgacgcagatagtgacggttgctcgctagtcttttacgaaattagtgagatgctgacgatgcgcctacacgaaatgggctttgactttatcaaaaccggtgaagaagggcacgttaaattggcagactttagtttggctggtaaacggctacggggtgaacgggccctaatgaataagtttacccgggatcactatgagtttgccatcttgcagccaccgttcagtgccgacgttatggctgaattacgagctgtttcggatagttggttagcaggtgagacggaaaaaggattctcgctcggattttttgatgagcagtatctcaatcaggcacccgtagcggtcgtttatgatcctgaccaccgaattgtcgcgtttgcgaatattatgccacagggaaatcatcagacgacttcaattgacttaatgcggtcaagccaatcggcgccatccggcattatggacacggtctttgtgcacctatttgaacaggcgcgtgacgatggctatgcctatttcaatatgggaatggccccgttatccggtgtaggggtttcacgctacagttttattcaagaaaaaattgctcatttaatttacgaatatggctaccagttatatggttttcagggattacggtcgtacaaagaaaagtatgtgaccgagtgggaaccgaagtacattgcgtaccgaaaacgtaattcactaatcttcaccattttacaattgctacaagtcgttaatacccgggtgcacaagtctgagcggcaccggccagtatggttgttgaaacgattgaaataactgaatagtatgtcataaagtaagtatcgttaatgacatagcaaaatgccccatcactgcgagaagcaatgatggggcattttatgatgactttagaattcagccgactaatatgatgagggctgaactaattgtggcagaagcactagagctgttttgcgtaggctagattatttagttcgtatacttaggcggtaacacatgtttgaaatcatggaaaccagcgaaaatttcatcaagatcatgcccattaatgaataggtcgaggttagcctcgggggcaaaccctaaatcggcggtcttttgtagcatggcgactagatcgtcgtagaagccgtcgatgttgtagagcgcaatcggcttttggtgaatatccatttgactccaagataacatttgtaagaattcttcaaaggtgccaaacccgccaggtaaaacgataaaggcgtcagcgaggtgaagcatcttttccttgcgttcggtcatcgtgcgcgtttcgataaaagtcgtgacgtccttaaatgcaagttctcttgcgaccagaaaatgcgggataatcccgataacgcggccaccagcatccatagttgctttggcgactttccccattaaaccatggtcgccaccgccatagacgagttggtaatcattagcggccaagtattgaccgagtgccaccgttttgtcactaaatgcgggatctaaaccagaattagacccacaaaaaacacagatattatgaattgccattctaaactacccccaagataaaattttctagcaaaaatgcggcccggataggcgccgcatttttgtgaactaacgtgttgattaatcgtctggattaccaatatcgtagtcggtgtcttgcattgcttcaacttgacccaagcggtaaccattcccaacttgtgagaagaagtcatgattagaagtccccgttgaaatcccgttcatgacgaccgggttaacgtcttccgcagtatctgggaagagggcatcttggccgagattcatcaaggctttgttggcgttataacgactaaaagtcaagacttcatcagaccaaccaatttgatcgtaaactaaatgaatgtagttttcttcattctcatagagtttgtataagaaatcgaacatccagtctttaaattctgcctgctgcttttcagaacggtctttgaagcctaattggaacttataaccaatgtaagtgccatggacactttcgtcccgcaaaatcaatttaatgatttcggcaacgtttggcaattgattgtgccccaagtagtacagtggcgtatagaaaccagaatagaacaggaaagtttccaaaaagacgttcgcaactttttgcttcaatggatcttcgtcgatgttatcgtaaagcttgtagatccattgggcttttgcttgcaagaattcttcactgtcactccagtcaaaaatttcattaatttcgtccggcgtattcaatgtttcaaaaattgttgaataactctttgcatgaacagattccatgaattggatgttattcaatacggccgtttcatgtgaggttaagacgttgcggcgaagtgcttgcagaccgtcttgtgattgtaacgtatccagcagcgtcaaaccgccgaaaacgtgtcccacgacccaccggtgatcatcatctaattcacgccagtctgccatgtcgttggaaactggaatccgggtgtctaaccaaaattgttcggttaacttttcccaagtacttttatcaattgcatctgaaactcgatcccagttaattgccttatagttgccattactgagcagtttttggtagtaagccaagtctgttgccatttgttatcctcctagagatctaagatactaaattacgcagctttcacattcgttaacaccgacttcgccatcgtcgtccgtaaaggtccgaatataataaatcgatttgatccctttgcggtaggcgtagttccgtaaaatgtttaagtcccgcgtggtcatcttatcagtgcgaccatctttccattcgtataagccagctggaatagttgaccgcatgaagagggtcaagctcattccttggtcaacgtgttgttgagcagccgcatagacatcgataactttacgcatatcagtatcgtatgctgacttataatagttaattgtatcattagataggtaaggagcgggataataaatcttaccaattttcttttcttgtcgttcttcgacccggttgatgattgggtgtaggctggcagtcgtatcgttgatgtacgagattgacccatttggggcgacagccatccggttttgatgatagaggccatcacgcataacggcttctttgagggcttcccaatcagctttggttggaatgaagataccgtcaaacagtgcagcggtcttgtcatattttggttgccaatcttgggtggtgtacttgtcaaagtaagaaccatcggcatacttggatttttcaaagttaacgaaggtttcgtgacgttcacgcgcaatttcgttagaagcttttaaggtccagtagtttaagagtaagaagtagatattggtaaagtcaacggcttctttactgccgtattccatctgattcttcgcgaaaaaggcatggagccccatggcacctaatccaatggtatgggcttgacggttccctttttggatggaaggaacgacgtcgacgttagagtggtcagtaacaaaagttaacgcgcgcaccatggcttcaacagaatgtccaaagtctggagaggtcattaagttaacaatgttagtcgaaccaaggttacaactaatatcagttcccaacttctcatactgttgttggtcatcaattaatgatggggtttgcacttgcatcacttctgagcacaagttactcatcacgattttaccgtcgataggattttcgcggttcgcggtatcaatgttgacgacgtatgggtagccagattcttgttgtaacttgctgatttcattttcaaggtcacgcgccttgatcttagttttacggatgttcgggttcttaaccatattgtcgtattctttggtgatatcgacatatgagaacggtaccccgtattcgcgttcaacgccgtaaggactgaagagatacatatcagcgtcagccttgatcaactcgtaaaacttgtcgggtacggtgacaccgagtgaaagcgtcttgagccgaatcttttcgtcggcgttttccttcttagcagaaagaaaggcaataatatctggatgaaagacactaaggtaaacgaccccggcaccttgacgttgacctaattggttagagtaggagaaactgtcttctaataatttcatgacgggtacgaccccactagcagcgccatcgatatgcttgattggatcaccggcaccccgtaagttgctgaggttaataccgaccccgccaccgatccgagaaagttgtaacgcggagttaatcgtccggccgattgagttcatatcatcggtcgattgaatcaagaagcaagaaatcaattcaccacgccgggcccgaccagcattgagaaaactgggagtggctggttgataacgttggtgaacgatttcgtcggccaggtccatcgccaagtcttcattaccatcagcaaagtagagggcgttcattgccacacggtcaataaagttttccaagtaatagtcgccatcatccgtctttaaggcgtattgggcataaaatttgtaagccgccataaacgtcttgaagtggaagtcttgcgaccgcaagtaatcgtaaagtttttcgataaagctaaaatcatacttatcaatggcaggggtttccaaatagtcgtgttcacgtaggtagtcaaagcgcgccttaagactatcaaatttcatcgtgttcggttcaacattttgttcaaggaaagcggcaagtgcctcctgatccttgttgagcggaatctgattgttaacgggaatattgatctcattatttaagtcgtaatacgtgacgtcttttaaatcttttaaggtcataaggaatcctctttctatcagtataattgtggctggcaaaatcgacgacccacaatcagtaggttgatgattgtgggtcgtttatcatattttaaagggtaaaccagctatgtaaccacgcaaaaaagcgtgaacaaactaaacagctaattgttttaaagcatcaggacggaagccggcaatgctgtcttcgccattgatttcaacgaccggaacagcatggaaaccttgattcttcaggtaatcgacgtattcaggattcgtattgatgttcttctcttcaaaggcaatattgtgcgccgtgaggaacttcttagtcatcttgcattgcatgcagttgtttttagtaaatacagtaacttttttcatttttcatcatcctaactcgtttttctgataaatttagtatacaacatgtggtgaaaaaaacaatcaaaaaacacaacatctagggtgtggtaaaaatcacaagccctagatgttgtgttagtgtcagcttttaaccgactaaaaagttttttaaattatttgtggttcactcgctgaatcagttatcatagatatagaccagaaatttagaggaaaataaatatgaccaactattattatacacacaatccggatattgtgcatgatgaaaagcaatggaattttgaaatttttaatcactcgtttaaatttacgacggacaacggtgtcttctccaagcgtaccgtggattacggctcacgaacactacttgcagcgtttgatccaactgatttgccagcgggcccaatgctagatttgggaaccggatatggtcccattgggatggcgctcgcgtatcaatcacccgaacgaacggttgatatggtcgatgtgaacgagttagcgctaagcttagcgcgtaaaaatgttgctttgaaccaaattacgaataccaatatttttacgtctgatgtctatcaacaagtgaccgcgactaattacgcggcgattgtcaccaacccaccggtgcgcgcaggtaaggcagtggtggatgcgatgttaacgggggccgtttcacggctagtcgttggtggaacactcaccgtcgttttacagaaaaagcagggcgcaccatctgcgaagaaattgatgcaaacgacctttggtaattgtcaggtgattaagaaggacaaagggtattacatcctacaaagtgtaaaggagggatagtcgtgacggaacccacagcggaagactggatgcaagaagcattacatgaagcgcggatggcctacttaattggcgaagtgccgattggggccgtgatcgttcaccagggtgaaattattggccgtggtcacaatttacgggagcatggtcaggatgcaacgatgcacgcggaaattattgcgattcaggaagcttgcgaatatttgcatagttggcgattagccgattgtcagctatatgtcaccttggaaccatgtttgatgtgtagtggggctattattaatgcacggctacctgaactctactttggtgcccgtgatcccaaggctggcgccgttcgtagtttgtatcaggtgatggatgatacccggttaaatcatcaagtaacggttcatgaacgcatcttggcacgtccggccggcgagatgttggaaaacttcttccgtgggattcgtaaacggaaaaaggcggctaaaaaagcacgacgtgaagctgctgaaaaaaattaggccgatggctggtaattgtggcgcaaatcatgtattatagtatttgccgcaaggccaaaaggcaagggtggatttacgaatcgtgtcaggtccggaaggaagcagcactaagtttgcttcatcttgtgccttttgtttttatgaaatgtaacagctcttagccattcggttgagagctttttatttaaattaaatattgagtgctagttttgaacgtgctgataggttggtttatttttatttacctattattatagtagtaatacgttatttgggtgatgcttttcaggctgatagttaaagccactgcttgttgaaggaataaccaaacgcctaacaaaggtggttaaaggcctgggcatcgactcgttggcaagtgcgcttagatgcttaatttgcataaccgacactgatcgttagtggaagcagcacaaccaggaagctaactgttcaggacgtttaaacaatggcttataataagtaatgataaccaaagtatgactgatgtaagaaaggaagaatcgcatgtatcgggcactatatcgggtttggcgtccccaacgctttgatgagattgtcgggcaacagatgattacccagacactaaaaaatgccattatgacccaccagacgagtcatgcgtatctgtttaccggtccccggggaactgggaaaacgtcggcagcaaagatttttgccaaggcaattaactgtcaccatcttgttgatggggaaccttgcaatgaatgtgagacttgtacggcgattaccaaggggcaactaaatgatgtcatcgaaattgatgcggcttctaataatggcgtggaagagattcgtgatattcgggacaaagcgaagtatgctccaacgcaagcggattataaagtctacattattgatgaagttcatatgttatcgactggcgcgtttaatgcgttgctcaaaacgctagaagaacccccggctaacgttatatttatcttagcgacaacggagccccataagattccattaacgattatttcacggacgcaacggtttgattttcggcggattacagctaaggatagctacgatcggatggtgtacatcctcaatgagaaggatgtgacctatgatgaaaaagcgctacgcgtcattgcagcggctgctgaaggtggaatgcgggatgctttaagtattctggatcaagtaatttcgtttggagataacacggttacgttggatgatgcgttaatggtgacgggaagtgtgaccaagcagttgctggctaactatgtcagtgaggtcaccgaccatgatacgaagccggcactagagacgatgcgacaaatcttacaagaaggtaaagatgcgaaccgtttcattgaagatttgatcagttatacgcgtgacgtgttactctatcaacaggcccctgaaatggtcgatagtgtggcgatgggcgaggatgatcaacaatttgaagcatttgccaagcaaatcgatgctgaagtcctgtatcaaatggtcaagacgttgaacgatattcaacaacaaatgcggttcacgacgcaccccgacgtttatttagaagtgttgacggtcaagttagctcagttggatggtcaagcggccgttcaaccggtagctgcggcaacggtcaatcctgaagatcccactgtgcataaactggcacaacaagttgaacagttgcaaagcgaggtcaaaacgttacgttctcaaggtggtagtgtcactaaacccgcaccggctaagccgcggtcgagtaatggcccggttgttaagaaggttaatgtcagtcagatttatcctattctgggagcggcaacgaagaatgatctcattaaggtgcgcgatgtttggactgatttgatgaacattttgagtgtgactcagcgggccctaatgcacgtggcccaaccagttgcggccagttcagaaggtgttgtggttgcgtttgactatgcgtttgtttatcaaaaagcgattgatgaccagaccttgatcgatgcactcggaaatggtttggatcggctgatgggacaggcacccaagattgtctgtgtgcctaaagaacagtggccacaaattcgtaaggattatttggccactcatcagccaggaggtgcaacatcagagcaacaagcaccggccaaagaaccggtcgttgaagaagctaagaatatgttcggtgatttagttgaagtacagccggactaaagacgaaaggaactgataattatgatgcgtggaatgggtaatatgcaaagtatgatgaaacaaatgaagaagatgcaggcgcaaatgacagccgaacaagcggctttaaatgaacaaaccttcacgggtgcggcgccagacgacatggtcaaagtcacttttactggtgataagaagatgaaggatattacgattaaccctgatgctgttgatcctgatgatgtggatatgttacaggacttagtcgttgctgcggtgaacgacgcgttgactgaggtcgatgaacagacacaaagtacgatgggaaaatatactaagggattacagtaaaaacgaggtaagtacatgcagtatccagaaccaattgctaagttgattgatagttatatgaagttgcccggcattggtggcaagactgcgacacggctggcgttttatacaattgatatgaacggtgatgacgtcaccgagttcgctaagtcgctgattgcggccaaacgggacctgcatttttgtagtatttgcggtaatatcaccgaagatgatccgtgtgtgatttgtaaggataagtcgcgtgatcaaagcaccgttctggttgttgaagaggccaaggatgtcatggcaatggaaaagattaaggaatacaacgggctgtatcacgtcttacatggggtattgtcacccattgatggcaaaggtccggaagatatcaacattgccagtttattgaaacggctacagcaaaatgaagccatcaaggaagtcattattgccaccaatgccacgcctgaaggtgaagcaacagcgatgtacatctcgcggttagttaagccggcggggatcaaagtgacccgattggcgcacggcttgtcggttggtagtgatattcaatatgcggatgaaatgaccttattcaaagcagttgaaggtcgccaagaaatgtaattggaggtgccaccatgtttaaacgtaaacagaagatcaagcatcccaaggaagtttttgatgaacagttattgtcgaccctgaatgccgctaagttggactgggaccgtgcgaagcagaaccaagaagcggtctatgataataatacgagtgaactagttacgcagaccgccttagcgcgtgctaagtatttatatctgtatcgtgaagcacgtttacgtcaagttcatgggcagacgattcagcgctcggtcattgataaatagactgttagtgatttaagagataacttgtttcaaaataaagacgcacgtcgttgatttttgtaaatctacggcgtgcgtttttgatttagaaccctagcattattttaccagttaatctgtcatgcattgtgattaagacatgctaggtgcggcaattggaatagaagatgtgtatctactaatgaataacaaactaaaatcggtatttatcaatcgtgggtagtactacctaataactttttagcaattcaccgaataaatcatcaaaaccacaattggtagtagccgacccacgtaaaaatcgtgaaaaagtaccctcactagtggtaaccgtattagacaggtactcaaaaatcaagtacaattgctacatataagaaaatagatgggattgggaatgttgacaggaaaattagttacttttgaagggccagacggtgccggcaaaacgtcagctttaaacgcgattgtggccaaattacagccacaattaggggatcgcttagttgtgacgcgtgaaccgggcgggaatcaaatctcagaagcaattcgaaaaatcattttagaccgtcataatacggcgatggacgaccgtacggaagcgttactctatgcggcagcacggcgacaacatatcgtccaaaccattcaaccagcattgcagaacgaccaacttgtcttgtgtgatcgctacatcgatagctcggtcgcttatcagggggccggtcgtggtattggggaacaagcggtttatgatatgaatcagttcgcgaccgcggggttaaccgcagatttaacgttgtattttgacgtagatgctgccgttggattaaaccgcattcaacaacatcgccaaaatgaaattaatcgcttggacgtggaagccttaagttttcatcaccgggtgcaagcagcgtatttgagattactggctgatcatcctgaccgtatcaagcgcgtcgatgcaagtcagccattggaccaagttgtgacgcaggccttagagattatggcgttacagttaccgacttatgtggcatccaagggaggggaagaccaatgaaattaattattgcaatcgttcaagataaggacagtaaccggttgagcagccagttcattgaagccaatgttcgggccacgaagctctcaacgacggggggcttcctacgttcaggtaataccacttttatgatcggtattgatgatgaccgtgtggatgaagttttagccatgattaaagaaacgagtcatgcgcgggaacagtttatgacaccaccagtcaatctagacgtgacgatggatggcgcagctgcctatccagttgaagttcaagtcggtggcgccacggtctttgttctaccaattgaacaatttcaccaattttaatgaaggatgattattaatggcaacaaccgagtcatttgcgcaaacgttagcggcgaaacagccccgcttattagcggcatttaaacacatcatcgcccagaaccatctggcccacgcgtacttattcgcggggatggaaggcgctggacaaccagaactggcccattggattgcgcaacggttgttctgcctgcatattaatgatggtgaaccagatggcacttgtgaggagtgcgtccggattgctaatgggtcgcaccctgatattgtgacagtggctcccgagggtcagcgaattcacgttgatcaggttcgttacttaaaagctgaattctctaagagtgcggtcgaaggtaaccggaaactgttcatcattaatgatgcggagaagatgacagcgagtgctgccaatagcttattgaagtttattgaggagccaagtggtaacgtcacggccttgttattaacgactaataagcaactgatgctaccaacgattatttcacgaacccaggtgatcgaattcccaccattaaatgcgcaggcgttacagcagacgtttgaacaggccgggattgcgccaaaccaagcgcagatgttacggggcctgacaaatagcgtgacccaggcgcaggcgttgctagcggatgattggttaccacaagctgcgcaagcattgtggcggtggtttgaccaggctgttaagggtgatccacggagttttgtggctgtgcaggtcaatttagttggtttggctaaggacgctgatcatcagctggttatgttggatttaattgcggccttgttccaagatctattgcaattacattttgaggtggcaacgacagcgttaacctttggtcagtaccaaaaagaattggccgggttaacggctgaagtcagcgatgagcagttgattgcggcgacagaactagctttaacggccaagcgccagctagctagcaatattagttttcaaaatgtcttagaaggcttaacgttaaagttatggccgatttttcaaacaaacgcttaaataaaggaaaacgagggtgagcgcgtggataagcgtgatttatacgatagtttcggtgagatggaacaacagatgcaacaaatgctagacaaaatggctaagttacgcgccgatatgacaacggtgttagagaaaaacgcggaattggtcattgaaaatgaacatttacgtgaacacatggtcgaaattgaaaatgaattgccgaaaaaagcggctagcacgaccacgctctcaaagtcacggcaaaacttggaaaaactctatgatgagggcttccacgtctgcaaccagttttacggcaaacggcgtgacgatgacgaatcctgcgttttttgtttggaagtcatttatggtgaacgtgaacgcgcatagtcgaaaaagtctgggagtagtcccagactttttgtgcttttcaccacgagtcactcataggaacaagtcacggtcgagaggattgttaggaggacgttttggaaacacaacaaagttttgcagatcatgcgggtatcgggaccttgtacttagtaccgacgccaattggcaacttacaggatatgacttatcgggcagtggcgacgcttaaaacggttgacctaattgccgcagaagatacccggaatacccaaaagttattgaatcattttgaaattacaacgaaacaaattagctttcatgaacataacacccaagaacggattccccagttaattgaaaaattacagacgggcgttaacttagcacaagttagcgatgcggggatgccgtcaatcagtgatcccggcaaagaacttgtggcagcctgcattgccgcgaatattccagtcgtgccactaccaggtgccaatgccggcctgactgcgctgattgcttctggcctagtgccacagccattttatttctacggctttttaccgcgtaagaagaatgaacaaaaagctgatttggctaaattggctcggcgacatgaaacagtggtcttgtacgaatcgccattccgtgttgccaagaccttgaccctcctagcgaccgtctgtgaagggacgcggccaattgtggcgtgccgggaattgactaagcgttacgaggaattcgcgcgtggaaccttggctgaaatggtgacgtgggcgcaggatcatcagttaaagggcgaatttgtccttttgatcggtggtaatccggataaggatgaaccagaaacaacggatgaattggcacagttgccagtcaaagcccaagtcgaagcgttgattgcagccggagataagcccaacgtggccattaagacgattgcgaagcgacgaaatattccccggcaaagcgtttataatcaatttcatgaactaaataccaacgatgaggagtcttgatgaatggcaactttaggcgcaaatgcgagtctttacagtgaacaacaccggattacgtattatgaatgtgaccgcactggtcgcgcaaccttaacgacattaattgatattgccgtactggcatcagaggatcaaagcgacgcccttggtttaacgacggaaatggtgcaaagccatggtgtcggttgggtcgtcacgcaatatgccatcgatattacacggatgccccgccaagacgaagtcgttacgattgccgttcggggtagtgcttataatccatattttgcttaccgtgaattttggattcgagatgcagatggtcaacagctggcctatattacgagtatctgggtcatgatgagtcaaacgacccggcgaatcgtaaaaattttaccagaactggtcgcgccgtatcagtcggaagtcgtcaagcgcattccgcgcttgccacgaccgattagttttgaagcgaccgatacaacgattacgaagccgtaccatgtccgcttctttgacattgatcccaaccggcatgttaataatgcacactattttgattggctcgtagatacgctacccgcgacgttcttgcttcaacatgatttagttcacgttgatgttcgctatgaaaatgaagtcaagtacgggcaaacggtgactgctcatgcgaacatcttaccgagcgaagtggccgatcaggtcacgacgagtcatttgatcgaagttgatgatgagaagtgttgtgaggtcacgattcaatggcggactttaccagagccgattcagtaatttgctgggttggtatttacactagtgtgttaatgatgtgatcgtgagcgacttggtcgattagaacgcacgtttttattagagtcgctggcgattcagtatgctatgattaatacatccatacaggggaggttcattatgtcaattttagttttagggggagctggctacattggttctcacatggtcgatcggttagtagaacacggtacggacgtcgtggtcgttgataatttggtcacgggacaccgtgctgctgttaattcggcggccaagttttatcagggtgatttgcgggatgcggattttttgaatcacgtttttgatactgaggacattgaagctgtcgtgcattttgccgccttttcaatcgtaccagaatcaatgagtaagccactgaagtactttgataacaatactggtgggatgatcacgttacttgaaacgatgcaggcccatgatgtgaagcaaatcgtcttctcatcaacggccgctacttatgggacacctaagcagattccaattaaagaaactgatccacagttaccaatcaacccgtatggcgctagcaagttaatgatggaacaaattatgcactgggcggacgttgcctatggtattaagtttgtcgcgttacgttactttaacgttgcgggtgccaagccagatggcagtattggcgaagatcatggccctgaaacacatctggttccaatcattttacaagttgcgcaaggaaaacgcgatgaacttaaaatcttcggcgatgactataatacgccggatgggacgaatgtgcgtgactatgtgcatgttgtcgacttagctgatgcacatatcttggctttgaagtacttggctgcaggaaatgacagtaatgcctttaacctgggttcttcaactggtttctctaacaaacaaatgttagcggctgctcgtgaagttaccgggcaaccaattccagctaagctagcaccacggcggcctggtgatccagactcattggttgcggcgagtgataaggcgcgtgacgtgctaggttggcaaccaaattatgacaatgttaacgatattattgaaacagcgtgggcttggacgcagaagcatcccaatggctacgatgatcgtgactagtatcggttagctgataattgaaagcggctttgaaatctcgtcaatagatttcaaagccgcttttgtggtcgtcaaaaaaggtgcatgtcaggattgagtccttggcacgcaccttttagattgatcaatgcagttagcggtgaagttgttgataatcaccgataattgttaagagtcgttgaatatcagttgtatcaacatcaccgatggtaccaattctgaagctagggatatttgaaaccttcccaggataaatgacgaagccgcgttgcttgatgaactgatagaagtcagcaaaatcaaagtcgacgttcgggtatttgaatgacgtaatgatgggcccttgaatggctggatcaatcactaattcaaaacctagcgcttgtaagccgtcgctaaggagttgttgactagcacggtaacgttggtagcgtggtgtcacgccgccttctgcttgcaattcaatgagtgcttgcgcaaaggcatgtaccacgtgggttggcgaagtgaagcgccattttcctggttgcttggtcatggcttgccattggtcgtagagatctagacaaagtgaacgagcgttgtcagcagtgtgggccaaggtcgcttgttttgcaatgatgaacgcaaaaccgggcacgccttgcacacacttgttggcactactaatcaagtagtcacaatccaattcatcaatgctaatcgggacgccacctaaactggacatggcatcgatgatcgttacgatcccgtgttcatgcatgataggcattaaggcttcgattgggttgagaatcccagttgtcgtttcgctatgaacggttgcgaagtgggtaatctccggatggtcagctaaggttgcttcaatccgaaccggatcgacggcttcatcttcgttgaacacaacgtcgatatgtggaatatcgtaatattctgcgatttgactgattcgatgcccatatgcgccgttaatggcaatcattaaagttgcatcggtccgtggtactgctgtgccaatggtggcctcaacaccaaaactgccgcttccttgtagtaggacggtcgtatagttttctggattggcttgggccatagctaagatttgttgccgaatggtttcggtgacgtgccgatagtcactatcccaagtacaataatcaatttgcattgcgtccttaacactggcagtcgtactgagtggaccgggtgttaggagtaaataaggttgtttcataaaaatcgggctccttgtctgctaatgatcagtggcaaccggttgattgatttgatcaagcaatgccggtaattcagccatcgattgtaaaatgtaatcggcaccagcgcgttgataagcggcagtgacgtgggctcgtcgttcagcttgttcggcggggctaagggcgttgaaggctaactcagaaagtcccatgatgttgctaccatcaataatccctacagagactgcgtcggcgttgttgccttctaagatatcattaacggaatccccaattttcatgacggttgttggatcggtgattgtgagctgttcagctgctaacgcaagcattgccggcgctggtcgaccaacaccaccagtttgttctgaagtgatgttgacggcgggacgatagccttgcttagctgcaatcggtaagaccagagctaacatttcagcgtcatagccggtggtcgtgccatagctgatattgtgagcggtcaaatagtcaattacatctgacatgccgggctttaattgtccgaattcagtcagggagctaagcaagattgccttgaagttgctaaagatttgattgcagtcgtcttcagtcggtaagacttggaaacgcgcctgccagtcgttttgaacggccggtaaatccatgattttatggatatgggtgtacttatctagtcccatatcttggcgaatctcagcttcagagatttgaataccaacgttggcaaaggctttttggaaagccacgatgggcgcccggctgccatagtcaatggtcgtgccggcccagtcaaaaattactgctttaattgtcattgatgaaaactcctttgaatttacttagttgttctttaagtagtggccacgtaaccgcatagaaaccagttcgagcacgattgcgacacccaagagtaggtagacaatcaaaccaacttcatggaaatcgaagtagaaactgccagccatgaagaggtagtaaccgatatcgtcagcaccggctgcagcaccaacggcgaccgcattggcaaagttaatttcaaaccggatgaacgtccagctaagaagtgctggaatgattgacgggagaatggcctgaaaaacaatcggccaaaaacccacgccactcgcctttaacgcttcaatcgtatcttgtgaggtttcttcaatactttcagaataagccttaaccaagtacgctacactgtggaaggtcaagccgaccacggctgcactagcacctaatcccatgactacggagtaaattaacacccataaaatcgttggaatggcacgaataaaggccatgactgctttaatactagtagctaaccaactgggtgctaagttacgggcagcaccgacggcaatgaagaaggcgattagcgctcctaacaaagtcgtcaacattgctaatgaaacactagtcattagggcccgtaagagttgccccagtgtgtcttgaccaacgctagggtgtaagaacatagcattcaggttgagacctaagctatgcaaagcgtcaatgatgttcaggttggcattattgagtgtgactaatgaatagacactgataagcgttaggccaatcataacggctcgcaggattttgcggggccgagtcaccaacgaaatcgaccgggttggtggtgctgacggttgaagtacttgtgttttgggttgactgttttcaatcatgcaattgccctccgaattcgattagatgtcaattctaaaacaatgactaaaatcgcaattaacaaaacaattagaccagcagcgtcatagcggaacgccttaaaatagtagtcaaagagaaaaccaacacccgtacccgtcaagagtccgaccaaggttgcgtcccgtaagttgttttcaatcatgtagagaatccaactagtcaaggtactagcggcttcgggtaacaccccacagaagacacattggaaatagttggcgccaacggcttgcagtgcttgaagcttttcggcatcgaggtcctcaatagtttcagtaaaggcccgtgttagatagcctagcgtcataaagaacagtgccaagaagcccgtaaagtcactctgtttaaaagaaaacagaagaatcatcgcccaagcgaccaccggaatattacgtaagagtgaagcaccaaaacgaataatccagcggaggacaggcgttggggtggtcgtcttagcaccgagaatcgcaaagatcagggcgaagagactagcgaccatggttgatgaaattgccacgagcaaggtccgccacagctgataaagaatcggtcccagataagaaatcgaacgacttgtcggaataaagttggtaaacaaccacattaagcccgctggaatcttactgattgaagcccacgcctgaaaattaacgagggccatggataagacgtagatgccaattaaaatgagcaaaacaactgataatcgcaaccgacgttgccgaaaaaagcgttgcggtgtcattggattagttttcattggcagccaccgccgttgattggtcaggttggcgataaatgtgttgtaagaccgcgtcgtcaacttcattagtggcgccttcgaaagcgatggcgccgctgttaatgccgacgatatggtcggtgtacgccattgcgatatcgacctgatgtagattaatgaggataatcagttgtttttcctttgccaatcgccgtagaatgtccatgacaatggtcgttgatttgggatctagggaagcaatcggttcatcacataaaatcatcttaggatgttgcattaatgcccgtgcgatcccgacccgttgttgttggccaccacttaattgatcgcaacgttggtaggcgtattcttttaaccctacttcgtcgagtagttgtagcgcctcttgtttttcggcgctactgtaaaggccgagcatgccagcaactgttgatttagcgcctaatcggccatgcagaacattttcaagggccgttaacggactgatcagattgtagttttggaaaatcatgccgatatgatgacgaactttgcgtaattcagctttgttcgcttgacgaatgtcagtgtcatcgagcaaaatttgaccactatcatcgcggatcaactgattgatactccgtaaaatagttgttttaccagcaccagacgggccgatgatggcagttacttcgcccggtttagctgtgaagttgactgctttgagcgaatgcttattggaaccatatgttttatctagctgaataaccttgagcattggcaaatcctttcattgtgaactaatggtacgtggtttagtaacctactaacttatgcgttggcgcgtaccacttgtcggtaacattaactaatttggacttttctgatttcttagggaacatcattggtgtcttcgcatttggttcagagaagatctttttgttttgggcaaaggacttcgacgtgaactcagtggcgatcttcttttgatcatccttgctgagggccttggtattgtatacccatgggccttgttgaacaggcatcatggcaatgttaacgaccgacttgccggctaaacttgtaaatggcgcttcggcgttatccttaacagtgaaagttgagccgaccttgtcccatgatcccttggtaacgtttaagtatggcattaaatcagcatcatcaaaggcagcgacatccgcatcccccttgattaagttgaccgcggaaccctgatgagagccaccatagagcactttactaaagaatgatccgctttgagttaatttatcttggtcagcggttttgatgttgaattcacgtgagatttcagccgttggtactaagaagcctgaagttgaactgttggaaacataagacatcttcttgcctttgacgttcttaatactgtacttaccgttttcttcatactttttggcatctttttgttgtaccattaagtaggagttataagtagcgtctttcaaggtacctttagcatcagattgtgcggcaaaaggtacaacatctttgctcttgtggtgtgcttggatataaccgttagcccccatgtatgcgacttgagctttgccggatgcaattgcttgaatcgcaacgttatagtcggtcgtggtttgtaatttaaccgtcttacccgttgccttttcaactgcttgcttaatggccgtacgggaaccagcaaaactcttggctgattcgttaggatagaagaccaccgtgatggttttgctgctatccgtactgctaccaccagatttagcactggttccgctagcgcaacctgcgagtcctaaacctaaaaccgaaatgaatgaaagacctaataatgacttactaacttttgacatagtttccaattacctccaagtaattttagttacttgtgtagcataacaaggtattgtaaatgtgcggacaaggattagtgaagtatatgtataagttatgtaaataatatttacattcggttttcaattcagtgattggtaagtatgagtggaaactggtcaggatagttgttgattgtttctggattgaattggttggttactaccgtaaagctttcaaagtaagtaaattatgataagatatgtgaagtaattcaaaatgaggagttttttaaaattatgaagttgttggcgattgatacttcgaatcggccattgagtgtcgcggtattagaagatacccagatcttggccacaacgaccactaatgttggccgtaaccacagtagtacattattaccgattattgaacaagccatggctcaagctaaattggcaccagctgatttagaccggatcgtcgttgctgccggaccagggtcgtatacggggttgcgaattggcgtgacgactgctaaaacacttgcctttacattagataaagccttagttggtgtatcgagtttggccgtgttagctggcaacattgtgacggaaggccaattagtggcgccgttatttgatgcgcgtcgtgacaacatctttgccgggttatatcggattaagaaccagcgtccagttgccgttatcgctgatcaacatatcagtgtgaccgagtggggccaacgattagctagttatgatgaaccaattacctttgtcggcgcggatgtcgatcaatatgcggatgctttgcagcaatcgttagccaagcagttcgttcgtgcagccccacaacttgacttgccccaagccgtagtactaggtttgatgggtcgaacgctgacacccgtgagtgaaattcataactttgtgccgaactatttgcgtttaacgcaagctgaacgtgattggcaagccaagcacccagaaaaggaacatgcgccctatgttgagaaaatttaaggagtactttcaaaaaatgaccaccggtggcaatcaacgtcgccaacgtgtattggccattcaaaatcacatcgttaaagtgggcgaagtcaattactatgtttcacgcgcactgattaccgatgtgcccgagatgctagccattgaacgggccgtatatgcgggacagacaccgtgggatgaaaatgcgtttaagacggaacttcgccgacagagcggtcgtttctatattgtgatgcgtcatgaagatcgcctcgtcgctttttgtggttgtgtctttgatgatcgccgccaagatgcacatatcaccaatattgctgtacatcctgatgttcaaggccaaggactaggccattttatgatgcaagtcatgatgaagcgggcgcgtaagttgcattaccaaacggtgacccttgaggttcgttacagtaatacgattgcgcaacaactttaccgcgatttagggtttgaaaagactggtatcaagaaacggtactattttggcgaccatgaagatgctattgatatgacttatcgtattccggtagctacggatgactgaacgacagcttgtcgccagtacgcagcttgacgcgggtcgggccgtccaagtttgttaccagttagcgacattagcatatcccggtggcgcaccttggcggcaagcgacgtttgcggcggacatggcgttaccaacggtacactatgatttattacggtggcaggatgaactgatcgggtttgtcagccgctcgacagtgcttgatgagaccgaaattacgaatattgcaattgatccggcctatcagcgtcaagggcatgcgcggtggttattaacagcctgcttagcacaattatcggcagggtccgtattcctagaagtccgggctagtaatctcgctgcccagcgcttgtatcagcaatgcggctttgaccagattgccacgcgtaaggaatattatcatgatcccgaagaagatgcgtggatcatgcgtaaaatgattaattaaaaggatgggaaccgtggaaaaacaaaacttgattttagcgtttgagtccagttgtgacgagactagtgtggcagtgatcaaagatggccatgagattttatccaacgtgattgcaacgcagattaatagtcacaaacggtttggtggcgtggttcctgaagttgccagccgtcatcatattgaacaaattacaatttgtattgaagccgcacttcaagaggcacacgtgacgtatgctgaccttgatgctgttgccgtgacgtatggccccggtctagtgggggcactgttagtcggtgttaatgcagctaagacagtggcatacgcgcaccaattaccgctgattccagttaaccatatggccgggcacatttatgccgctcggtttgttaagccattcgaatttccgctaatggcactattagtttctggcggtcatactgaattggtctacatgcaagcagatgggcagtttgagattattggtgagacacgtgacgatgcggctggagaagcttatgataaaatcggtcgggtattgggtgttccatatccggcaggtaaagtcattgacgagatggcacatgcaggtcacgacactttcaaatttccgcgagcaatgattgatgaagataattacgattttagttttagtgggctgaagagtgcgttcatcaatacggtccatcacgcagatcaaattggcgcgactctggataagaacgatttagcggctagctttcaggccagcgtggttgatgttctgatgagtaaaacgttacgagtcctcaaacaatatccagttaagcaattagtcttagccggtggcgttgcagctaatcaggggctacgtgaacggttacaacaagatttaccaaccgcttttcctgacaccgaactaatcttagcgcctctaaagttatgcggtgataatggtgccatgattggtgctgcgggctatgttcaatatcagcatcaccaattcggcgacgcggcgctgaatgccgatccaagcttagaatttgattggatgccaggtatgttgaagtaatgaagcagttataaacgggtgtgaaaagtcagtccttttcacacccgttttagtatcttttcattaattatgattgaaaggtgccggttaggtggattcctgttcgtcagcaatgcgcgtccgattccgacctccggggcnnnnnnnnnntcttgaggcgactattatttttatctgatgagtcgttggaaaattagctcaattcttctaaagcttcagcttgttcggtccattcggtttcaacttgttcttgttgagtattgatggcttcaagttctttttgtaggtcttgtagtttaccaacatcggccgatacttcaggttgcgccatttcagtttgaatctgtgtggcttgttcatctaaggcagtcatctgttcttccagggcggcaactgagcgctcaagcttgcgtttttcacgttgttgctgcttgctggcttggtaattttgctggcctttggagcggggagcagcagttgtggcactggttgaatccgctgcaccggcttcagcagctttttcggccgcttggctagcagccgcagccgcgatttcagcttgctcttgtttcttgtcgatgtagtagtcgtaatcacctaagaagagttccgtgccttccggagaaacctctacgacactcgtggcgacttggttaatgaagtagcggtcatgtgacacgaacaaaagggtgccgtcaaagtcgttgagggcgacttccaaaacttcacggctatcgatatccaagtggttagttggttcatctaagattaagaagttgtcattttgcatggcaagtttggtcaacagtaaccgggctcgttctccaccagatagggcatgaacgggtttatcaacatcttcaccagtgaagagaaaactgcccaaaatggtacgaatgtctttttcaggagtggtgggatgttcatcccaaagttcactgaggacggtttttttgtcgtttaaattacgttgctcttgatcgtagtagcccgtaacgacgttggtgccaaaaacggcctggcctttaatgaatggaatctgtcccaaaatactctttaggaaagtcgattttccaataccgttcggtccaacgatggcaatagcttcatgtttcttaatattcaagttgtcgggttccgaaagaatctgaccatcatagcccacggctgcatctttgacggtcaacacaatgttgccgctttgtttagccgcatgaaagccaaagtgggcagtcttctcgtcactatcagggcggtcaaggcggtccatctttgctaactgcttacgccgagcctgggcccgttttgtcgtagaagcacgcacgatgttacgattaacaaagtcttcaagcttgctgatctccgcttgttgcttttcataatgtttccattgtgcttggattcgagccgctttttcttgcacaaactggtcgtagttaccagtgtagtgcaccatttcatggtgtgataagtcatagacttcgttaacgacccggtctaagaaataacggtcatggctaacgattagcagcgcaccagagtaagactggagatagctttccaaccaagtaagggtttcgacgtccaagtggttcgtcggttcgtcaaggataagcaagtcccgtttttcaagtaacaacttggccaaggccaactgggtcttttgtccaccggatagtgccgtcaccgacttatcgtacacatcggcgtcgaattggaagccgtgcaacacgccccgaatctcagcttggtagccgtacccgtttttttgttgaaattcagtttgaatctgatcataggttttcagggtctgttgataagcctgctcatcattcatgattgcggggtcgctcaattgattttcgagctggtgcatccgtttttcgatggcatgtaactcagcaaagacactactcatttcttcccaaatcgtattgttactatccagtccttggtcttgcgccaagtaaccgattgttaagcccttgcgcattgaaatatggccttcgtccggtaccgtttcgccggcaatcattttaagtaaggttgattttccggccccgtttcgaccgacaagggccacccgagcgtgttcttgaatatccatttgtacgttatcgaacaagacatcggcgccaaaacgccgcataacttgctgtacttgtagtaaaatcacgctttattaagctcctttcacatttaattcgtgacataattgtagcatattgtaacggcctgacccaattattcggaataataagtaattattatttcacaaagtcacgcgttatgctagaatagtgtcagcaaattcacaaacttttaattaggaggacacgtccgaatggcagaaacaaaaattccacgggcaacggcaaaacggttaccgatttattaccgctatttaaatatcttgctagatgcagataagaagcgggtctcatcgaccgagttgtccgaggcggttaaagtagattcagcaacgattcggcgagatttctcgtattttggggcgctcggcaaacgagggtatggatacgatgttgaaacgttacttgcatttttcaaaaagattttaaatcaagacaccttaacgaatgttgctttaattggggtcggtaatttgggccacgccctactgaactttaattttcacaaaaacagtaatgtccgcatttcagcagcatttgatatcaacgaggcgattgccaatacagtccaaagtggggttccagtgtacccaatgacggagctcaaaaagcaattgatcgaacaacagattgagattgctatcttaacggtgccaaccacggttgttcagaaaattaccgatgacttggttgatgcaaacgtcaaaggaatcatgaactttacgccgttacgaatctccgttcctgagacagtacgggttcagaacgttgatttgaccaacgaattacaaacattgatctacttcattgaacattacggtcagcaattaggtgacaatggtaatgacgatgaaaatgagactgaagattaataactcgctttatctttgaaattaaatggctataaaaaggcctctctgaattattcagggaagcctttttaacatacttagatcacgaatcattgattgtaacgtataaatattcggtgaaaattaacgttgaaacgctaggttagcgctacctagtaatgatactagtgcagtaagcctaataatgtgggtaacacaaccgatgcgttcattaggatgtgagccgtcatcgatgtttgaatccgaccggtgtgctggtataaccagcagaataataacccgataaaggcatagaggataaagtgaccatccgcatgtgcaaagctaaatagcacactagaaatcaaggccgccccaatctgaccagtaaccgcacttagattgccaaagataactttgcggaagacgatttcttccataatcggggcaccgacaatgatggctaagaagaaagcgggatattgttgcccaacagttaagagggtggtcgtgttggttgacgctgttgactgtcccagtaaagccgtcatttttaaaatgatgacttgaccaacgatgactaggacaagaccgatcaatccccagatgaacgtcatgaaccagttacttggttgtttttcaacaacgttttttgtccgcatgcgactcgccaaccagatgagtaggattgcaccgactaagtagtcgaccgtttgaatcacgaatacttgggcccctagctgatggaaagcagtcacaaggacgctcggtagtgcgtaaataataaagtagatgataagaataaagattgattggcggcgattaaccatcaagtcacgtccttttaaaagtttgatttaagatttattgatacttcaatagtattcattatagtcgatttgacattctttgactaataattgacaaatcacttgcaatcttgaattaaaatgatatagttgacaatgtaattagcacttgaggttgaggagtgctaaaaaagaataaatggagggattcacgtgttaaaaccattaggagatcgcgttatcttgcaacaacaagaagaagaagaacaaacaattggcggtattgtcattgccaataacgctaaggaaaagccccaaagcggtaaggttgttgccgtcaatgacggtcgtgttttagataacgggacaaaagttgaccccagcgtgaaggtcggcgatcaagtattattcgataagtatgccggtaccgaagtcaagtatcaaggtgctaagtatttggtattgcacgaaaaagatattgttgcaatcgaagactaatccatttaaattgcgcaacttaaaataaattaaattcatgaggtgaatagagataatggctaaagaattaaagttctctgaagatgcacgttcagcgatgctaaaaggtgtcgatcaattagctgacacagttaagtcaacgttaggtcctaagggtcgcaacgttgttttggaacaatcatatggttcaccaacaattactaatgatggtgtaacgattgctaaggcgatcgaattagacgatcatttcgaaaacatgggtgctaagttagtttctgaagttgcttcaaagactaatgacatcgctggtgatgggacgactactgcaacggtcttaacacaatcaatcgttaatgaaggtatgaagaacgttacggccggtgctaaccctgttggcattcgtcgtgggattgaagaagctactaagacggcggttgactcattacacgctatggcacacgaagttaagacgcaagaagatattgcgcaaatcgcttctgtatcttcagcaagtgaagaaactggtaaattgattgccgaagccatggaaaaagttggtcatgacggtgttatcacgattgaagaatcacgtggtgttgatactagcttagacgttgttgaagggatgcaattcgaccgcggctacttatcacaatacatggttactgataatgataagatggaggcggatcttgacaatccatatatcttaattactgataagaagatttcaaacattcaagatatcttaccactattacaatccatcgttgaacaaggcaagccattgttgatcattgctgatgacatttctggtgaagctttaccaaccttagtcttgaacaagatgcgtgggacgtttaacgttgtcgccgttaaggcacccggttttggtgatcggcgtaaggaacaattacaagatatcgctatcttaactggcgggacggttatcactgacgaccttggccttgaattgaaggacacgaccatcgatcaattaggtcaagccaacaaagttacggttactaaggataacaccaccattgttgaaggcgctggttccaaggatgctatctcagaacgggttgaatttatccgtaaccaaatcggtgaaacaacttctgactttgacaaagaaaagttacaagaacgtttagctaaattagctggtggggttgccgttgttcgtgtcggtgccgctactgaaactgaattgaaggaacgtaaataccggattgaagatgctttgaacgcaactcgggccgccgttgaagaaggctttgttgctggtggtggtactgctttgattaacgttatcaaagatgttgctgcattgaaggaaactggtgacgttcaaactgggatcaacattgttaaacgtgctttggaagaaccagttcgccaaatcgctgaaaatgctggtttggaaggctctgttatcgttgaaaagatgaaggaacaaaagccaggtgttggtttcaacgccgcaactgatgaatgggttgacatgatcaaagctggtatcgtggacccaactaaggtaacgcgttctgctttacaaaatgccgcttctgtttcagcccttctcttaacgactgaagccgttgtcgctgaaaaacctgaagaaaatgcaccagctgcaccagccgcaccaaacccaggtatgggcggtatgatgtaaacaaatcgtaacattaagcacttactcggctgagtaagtgcttttttagtgctgttagggtgtgaatcgactagaataaaggtattgatttatccatattagagcggtaggattagtcgttaacgcaaaatgtgggtgcggtgaagcacccgacatttaactggtagtatttggcagggtaaagtagtagaatctactttgactcagtttactttgggataattattttggaataaaggagttattatcatgtggcgttatttaaagcggttagttattgggaaaccgttaaaaaccatggacgagggtgggcaagcactcaccaagttcaaggcactggcgctgctatcgtcagatgcgctatcatcggtggcttacggtactgaacagattacgaccgttttgattacactttcagcggccgcgttgatgtatcaattgtacgtggcggcgcttgtgttagtgctgttgtttgctattacgatgtcgtaccgacaaattattcgggcttatccatctggcggtggcgcctacgtggtggcaagtacgaactgggggcggccagccggattagttgccgggggatcactgctggttgattatatgctgaccgtagcggtttccgtcacttctggtactgaagcaatcacgtcggcgattccggcgctagctaattatcaagtattgattgccgtactgattgtcatcgccatcatggcgttaaatttgcgtggaatgcgcgaatccgcatcattcttaacgtttcccgtttattttttcattattatgattatcggcatgattctatggggcgttatgaatattgcgagtggtaacttaacttaccacgcctccgcagcagttggagcaccggttcaagggatgaccttggtgctgttcttacgggccttttcttccggttcgtcttcgctgactggggtggaagcaatcagtaatgcggtgccaaacttcaaacgaccgaaacgcaagaatgcggcgaacacgttagcaattatgtcattagtcttggccgtcttctttggtggtattacttatttaagttattacttaggcgttaaaccacaagtagacaataccgtcttgtcacaaattgctacggcggtctttggtcacggcttattctactacttgttacaattatcgacggcgttaattctggccgttgcggcaaatactggtttttcagcctttccaattttagcttataacttggctaaagataaatttctaccacatgcttacatggatcgtggggaccgcttgggctactccaatgggattatctcattggcggtcggggcaattgcgttgatctttatctttcatgggaagacgacgcttttgattccactttatgcggtgggggtctttgtcccatttactttgtcgcaatctggtatgattattcattggttccgcgaacgggggcaatggtggtggatgaaggcggcggtaaacttacttggggcgttgatttcgattctcctagtgattttcctattcttgctacatttcggcaatgtttggccatacttaatcgttatgccactcttactgtacatgttctaccgaatccacgtgcactataaccgggttgcggcccagttacgcgtggttgccaaggaaaaagcgacgattcatgattatgacggtgcaacggtgatcgtcctcgtctcgaatgtgacgcgggtaactgctcaagcagtcaactacgcgcgatccatcggagattacgtcattgcgatgcacgtgtcctttgatgagaaccctgaaaaggaacacaagacggcggcagagttcaaagagaccttcccagacgtccgtttcgtggacatccattcgtcgtatcggtcgattgcaacaccgacgttacgattctgcgatgtgattgctaaacgagcagcggaacgcaacttctcgacaacggttcttgtcccacaattcgtgccgaagaaaccatggcagaatattttgcataatcaaacgagtctccgattacgagcggtattaaattctcgtgaaaatattattgtttcaacttataattaccatttaaaagaatagtgacttagtattgaaacccggtatagctaccgggtttttatttttgtgtcataatatgagtaactaaggttataatttagatacttaatcagcccagtgaccggcaaatgtgaacgaattgtgttgcctttactaagttttagtgaagcgagttgtcaagcgtcactgggatttgtataattatcgtaatagagtgagaagggagttacgcacaaatgatcagatttgaaatcctagtaagcctagtggcgaccatgatactttctgcgatcttgacgccgtttgtgcggaaacttgcatttaaaattggtgccgtggataaaccaaatgtacgacgggtcaataaaattccaatgccgacaatgggaggcttggctatttttatctcttacaccgttgggacgactgtgttgtatctcatgcaccagtttcccagtcgcatttttttcgcactactcggtggtgagctgatcattattgcgactggtgttatcgatgatatttatgagctaaaaccacggcaaaaaatgttagggattacgttagccgctttggaggtctactttattggtggtatccgaatgacgaccttcacgttcccgttgctggggctgattcactttcagtggctgagtttaccggtgactttactgtggatactggctatcacgaacgcggtgaacttaattgatggactggatgggctagctaccggtgtttcgattatttcgttgagtaccatggggatcatcgggttgttcttcttgaatgctaatatgttcgtttcgttgttgatttttactttagttgcggcgatgattggctttcttccgtataatttctttccagctagaatttatctcggtgataccggttcgttgtttatcggttttatgacggctgtgttctcattatttggattgaaaaatgtcaccttaatctcagttggtattccggttatgatcctgggagtgccaattacggatacggtgtatgcgatgattcgacggatcctgaataagaagcccatttcgcaagcggataagcatcatttgcaccaccgcttgatgcaattaggattgacccatcgacagactgtgatggtaatttatgggattgcacttattttctcatttatttcattgctctatccgatctcatctatttggggttctgtgttattgacgattggtttattatttgggctagagttattcgttgaagcaatcggattagctggtgacaatcggcaaccgctactggattggatcaaacggaccgtcgcgcgtttgacctccaagagtaatcattaaaaaccaaataaatcattgaaaattattaaagtgttacaggcatctaccgtgtgattagcggtgatgcctgtttttagttggtcatcagttggttcatcaattttaactttaccaaaactatacaagcaatttacacaatcgtcattcacaatttacaaacgattagtaatattaagcatgttccgaagcaatcaattacgtgtaaccgtcggatggtgatgttgctccatcactagtcgtagcactcctacccagttttgctatgatggttgccgggttggttgcttaattttgatagtcaattgaagaaggggagtttcaattatgaaaaaagcactgacactcggcgcattggcagtaacgatgaccattttactagctggttgcggcagtagctcagccacaagtacgaagagtactagtagcagtagtggtagttccaagactactaagatcgttgcaactggttcaaccgctttacaaccattagtggaacaggctggacaggcttaccagaacgaacatgctaacgtgaccattaacgttcagggtggtggttcaggagcaggcttaagtcaggtggcgaagggttcagtcaatattgggaactctgatttatttgcacaggaacaaaaggggttagacgccaaagggttagttgaccataaagtggctgttgtggggatggcacccgttattaataaggatgccggtgtcactaatatttcaaaagaacaacttatcaagattttccaaggcaagatcactaactggaaagatgttggcggtaaggacgaaaagattaccgtcgttaaccgtgctcaaggtagtgggacccgggcgacgtttgaaaaatggggattagacaacgcgaaggtcgcaactagccaagaacaagattcgaatgggaccgttcaaaaaattgttagcaccacgcctggtgccatcagttacttagcattctcatacgttaagagtgacgttcaggcgctttctattgataacgtcaaaccaaccgaagctaacgtagcgacgaacaagtggaagatttgggcttatgaacacatgtatactaaggggcaaccaactggggagttgaagaacttcttaacttacatgacttctaaagccgttcaaggtagtttagttgagaaattaggatatattccattgacttcgatgaaggttgatcgtggccaatctggtgcaatcactaatttaaaataaataacagacaaaaagtcgagcgatagctcgactttttttatgggccgcaattagtgcaacgcggactttaacaatgaaaaaacaaatcatcggctcaagtgctgggtgttattgttaagacgagttggctgtttcgattttgactgccaatcaaagtttgtgaggctcccaattatatataaccagcaatctagttgccaggcgtagtgaccggaatttctgtaaattgttcaccttgctccgaaaaggtaacttgaccgctcaagaggttagtgatgtcctgctgaatcgttgcaatttcggattgagtgactgcgatgatttgtgtgacttgaacaccgtagtcggtattcagagtcgttagcttattttgttgtaaatagtaggttaaagcatcgacgttacgatagtcgagcgtgatggcgatgcgggtttgtaagattcgctgaaccttaccactgacttcaattgcttgcgcgggggtgccattataagctcggatcagtccaccggcgccaagcttgataccaccaaaataacgggtcacgaccgcaagcacgtcgtgtagctcgttggtcttgagcacttctaagattggtgagcccgcagttccgaccggttcaccgtcatcactcatccgctgaatatgatcatcatcaccaagcatgtaggcgaaacagttgtggttggccttaggattatctgctcgaacagcggcaatcttagcttgagcatccacttcgtcactgatgcggtatagatgagcgatgaagcgagactttttgatggtttgttcaaataccgtgtcttgggtgatggtgtagtagggtttagtcaaattaatcggttcctttcgtgaataaatcgttaaatggcgtacttgataactaaggaggtgcgcacgatggaagcacaagtcttatacggtcgtcagctcgcattatctgcaaatgaggctgccgcagtacctgctggcacgcagatactgccagccatgcaggttgatgaacatcaaattatctgtcagcgttgcggcagtcacttggaccgactgcgagcccaattacccaatcagcaatattactgttatcaatgtttaaatttaggtcgagtgagtacactagttaaactctatcatatgccagaaccgaatgcttttgcaacggtcccggtttgcacgtggcaaggaaccctaacgccccagcaagcggactgcgcgcaatcaatcaaagctaacttcatggcgcataaacggcaattattatgggcggtgacgggagctggaaaaactgaaatgctgtttccaggtattgcgtgggcgttagcgcatcagtggcgggtcgccattgcttcaccacgagtcgatgtttgcttagagttagcaccccggctccaggcggcctttgctgatgttcaaattgctgtgctacatggccgcaatcccgatccctatcagtatacgcagctgacgatttgtacgacgcatcaattgctacgttttcgtcaggcgtttgacgtattgatcattgatgaagttgacgcgtttccgtttgctgccaatccccgtttggcgtttgcagtgaatcaggcagctaaggtggagggggccattctttatttgaccgcgacgcccagccaaagtttgttgtcccaagttcatcgtggtgagcttgcaatcagttatttaccattgcggtttcaccaacatttattaccggcaattaaggttaagctacagccaaattgggctcggctgttgcaacaaggaaaattaccacgagaccttatccggcaactccaacagtatcaacaacagcaccagcgctttttactatttgtcccgcgcatccaacaattagcgccagtgtttgcggtactccaacactattttccccatatgaccggagagacggtgtactcagccgatcctgagcgactgactaaggttcaacaaatgcggaaccagcagtttcaatacttagttacgacgacgatattggaacgaggggtgacgtttccgggaatcgatgtgattgtgcttggtgcggacgacgaagtgttttctacggcggccctcgtccagattgcaggacgggtcggacgcagcagtgagcgtccgactggcctcgtctggtttatttgtcacagtcatagccgcaatatcaaacgcgctcagcgccagattcgggtgatcaatcgaaaggggcgacaattacgtgctagcatgcctactgtgtcacaacattatcacgactaagtttacgttgccctggattcttagttggcagccggttatgcggccggtcgtctgctcggtttgttggcggcaatttgtacgcatcgatcgggcaacggcatgttccaaatgtggacgtgctcaaaaacgaccacaaccgtgtacagattgtcagcggtggcctgaaatcggtccctttcataacgaggcgttgttcgaatataatgatgcgatgcatgattattttcaacgctataaatttcagggtgattatcaattacgccaagtttttgcgaagatcatgcaacaagcagtggtacaacggtgtgctgagatatgcttagtggtacctgtcacgcccacaacattgcaaacacggggctttaatcaagttgccggctggttagccgcacccctcgcgcccgggttaatgacccaggcaacagcgaagtcagtgccacaatctaagaaagaccggcaagcgcggttgagaacaccacaaccattcaagatggctcctaatacgattttggccggccggtattattagtagatgacatctatactaccggccgaacgatgcgccacgcggcaacgctacttttggaaaacggtgccaagagcgtgacggggctaacgctagcacgttaatttcgagggaaagtggtatttggattgtttattatagcgctttctattataatgaatttaagcaaagtaattaaagagtggtcctttaattactttgggtaaacagcaatgtgtgtgaagggagagaagatctatgctaaattttaatattcgcggtgaaaatatcgaagtgacccaagcaattcgggactacgttcaaaaacgggtgggtaagttacagaagtactttgacaataatgttgactcaattgcccatgtcaacttaaaagttcacccagacaagacggctaaagtcgaagtcaccattccacttccctatttagttctccgggcagaagaaacttctcctgatatgtatgctagtgttgatttggttactgacaagttggaacgccaaatccgcaagtataaaactaaagttaaccgcaaatcccgtgaaaagggttataaagcgattgattttgcagcgactgatgaaacagttgccgctgccgacaatgatcaggacgataagttagacgttgtacgtacgaagcgagtggctttaaagccaatggataatgaagaagcgattctgcaaatggatatgctcggccatgacttctttatctacgaagacgcggaaacggacgcaattaacatcgtctatcggcgtaacgatggtcgttacggtttgattgaaaccgacgacaatcactaattttaaaagcgcaacttataaggactggtcagttgaccagttctttatttttatcccggaacgcccgtataacatattgtgatcatgagagtgacttagcccgcgttagtaagctgaagttcgactcacggcacgtttttgccagcgactcaagacagttaagcaaatattgatagaattaaagaacacgggtcagtgattgttgggctgtggttaaagactaatatttagttaaggatgtaaataaaacggtcgacggtatcggttacataggggcctgtggttttcattgctagtaaataatggtaaaatgacagatggtattttattttgaaatggacaattgaaattaaaattaagattaattatttggagaggatacgtaaatggccaacattttaaaacgctgggttgaaagcgacaagcggactattcggcgtctggataagattgctaataaagttgaagcttatgccgacgaatacggcaagttaagtgatgctgacttgcaagcgaagaccccagaatttcgtgaacggtacaaggagggcgaatcgctcgacgatttgctgcccgaagcatttgcaacggcgcgtgaaggtgcgaagcgggtacttggtttatacccattccacgttcaaatcctcggtggaatcgttttgcatcaaggtgacattgctgaaatgaagactggtgaagggaagaccttaacggccactatgccagtttatttgaatgccatctctggtaagggtgttcacgttgtgacagttaatgaatacttatcagcgcgtgatgcgactgaaatgggtgaactgtataactggttagggatgagcgtcggaatcaacggggctgaaaagtcgcctgaagaaaagcgtgccgcttataacgccgatattacttattcgacgaacggtgaaattgggttcgattacttacgtgataacatggtggtctaccgtgaagacatggtgcaacgaccacttaattttgccatcattgatgaagttgactcaatcctaattgatgaagcccggacaccattgattatttctggtcaatcagaaggtacaacgggaatgtataagcgggctgaccgttttgctaagacgttgaagaaggatgaagattacaaggttgacttggaatctaagacggtcgcattattagacgaagggattcggaaggctgaaaaatactttggcttggaaaacctttacgatactgataatacggcgttgaaccattacttggatgaagctttgcgtgcgaactacatcatgttgaaagataaagactacgtgatttcagacggtcaggcgttgatcgttgattcctttacggggcggatcatggatggtcggcggttctcagacgggttacaccaagcaattgaagctaaggaacacgttgagattcaagaagaaaccaagacgatggcaaatatcacgtaccaaaacttattccggatgtacaaaaagttatctgggatgactgggacggccaagacggaacaagaagaattccgcgaaatctataacatggaagttattacgattccaacaaaccgcccgatgattcgtgatgaccgttcagatttgctttacccaacgttacaaagcaaattcaacgcggtcgttaaagaaatcaaacagctccatgaaaagggccaaccaatgttaattgggaccgttgccgtggaaacgtcagaatacttatcgcatcgtttggatgaggaaaacattccacacgtggtcttgaacgccaagaaccatgcgaaggaagctgacattgttgcaaacgccggtcaacgtggtgcggttaccattgccaccaacatggctggtcgggggaccgatatcaagttgggacctggtgtcaaagaagtcggggggctcgccgttattgggactgaacgtcatgagtcccgccggatcgataaccaattgcggggccgtgctggtcgtcaaggtgatcctggtatgtcacaattctacctctcacttgaagacgatttgatgctacggttcggttcagaacgaatcaagaacttcctgcaacggatgaatgttgaagatgatgatgcggttattcaatcacggatgattactcgacaggttgagtccgctcaaaaacgggttgaagggaacaactatgactcccggaagaacgttctacaatatgatgatgttatgcgggctcaacgtgaagtgatttacggcgagcggcaacaagtcattatggaagaaaaatctttaaagcccgttatcatgccaatgatcaagcggaccgttgaacggaccgttcagttacacatgcaaggcgatgccaaggactgggatttagatgcagttgttgactttgcccaagctgctatggtgaaggaagattcaattagtgtggctgacttgaaaggtaagtcgccagcagaggttgaagcttacttgatggaccgggtcgataagatttatgcggacaaggctaaacagctttacgatgcgggtcagatgctagaatttgaaaaagtcgttattctgcgagtggtcgattctcattggacggatcacattgatgcgatggatcaattacggcaatcgatcggtttacggggctatggtcaattgaatccgttagttgaatatcaacgagacggttaccagatgtttgaagaaatggttgcggatattgattatgatacgacgcgactcttcatgaagtctgaaattcgccaaaatattcagcgttaaaatttaacgttagtgctagcgagtctaagactaaggtcttaggctcgttttacagttaaaccagatattaaataattaataaataagttgaaagaagggtcctttgtggaattaagtgaatataaacacctgattgaagaaatgcaaagtgctgtcgacgactttagggggtcgctttgacttagatgctttgaacgaaagcattcaagaaaatgaagctcgaatggccgaacccggtttttgggacgaccaggctgccgcccagaaagtcatcgatgagaataacgtgttgaaaggaaagtatgatacgtttaagcaattagctgatgaagtcggtgacttggcagtcgcttatgagttactgagtgaggaacccgatgctgagatgcaggctgagtttgaaacggactttcagcacgctgaacatgatttacaacagtaccggctcaacttacttttggacggtccgtacgaccgcaataatgctattttagaaatccatcccggagctggtgggaccgaatcccaagattggggtgcgatgctactaagaatgtacacgcgctgggctgcgagtcacaatttcaaagtcgagactgttgactaccaagctggtgatgaggcaggcattaagagtgtgactttattaattagcgggcacaatgcttatggttatttgcggtcagaaaaaggggttcatcgtcttgttcggatttcgccgttcgatgcggctggtcggcgccacacatcttttgcgagtgttgatgtgatgcctgagttagatgataccgtggatgttgatattcgacctgaagatttgaagattgacgtttatcgagccagtggggccggtggacaacatgtcaacaagacttcttcagcggttcggattacccacgtgccaacgggaatcgtcgttgccagtcaagcacaacgttcacaattacagaaccgacaaacagcattgaacatgttgcgagcgaagttgtacgaacgtgaagaagagaagaaggctaaggaacgggcggccatccaaggtgagcaaatggacattgggtggggctcacaaattcgctcctacgtttttcatccgtatacgatgatcaaggatcaccggactaattatgaatcacatgatggtcaggctgtcatggatggtgatcttgatccgtttatggatgcttacttacaatggaaattagcccaacgtaatccgcaatagattgcacaaatactaaggtgacctatcattgcgcaggtcgtcttagtatttttttggctactagtcttataatatagagatattaaagcggtaatagcaggactgacggaattgaaacggcgttggtctccttgggcaaaaatgctatactaacttcagagtttaacgttaggggtcacgcacatgcaggtattaaagatttttgaattgtttcttttacaaccgctagtttggttaggattgctgcgtagttatttaaccgctaaacggcgggtgaagagtgaacggcagcattttcagagtgctatcaacccacaattagttgaagtccaccactttttagtggatggctgtttactaggagttctaatgacaattattagcttggcattgggattagtggtggcccccatctgggtggttatatacgaagtagtggcggccattagcttgatcattattcctggtgcactggtaccagtgaccgcttttggcctcagctggttagtttattggattatgagcccggaattaacgacggtggggggcgctttacaacggcacggtgttgccatgaccagtatgagtggcaatttggtggtgaacggactattgttattagccatcgtgctggcggctacggcggtcttgttacgacactatgattatgagggccgttcaccgcaactacagcccgaccaacgtggaaagcgacttgttcgttaccagtggcaacaattgttggtcttaccagttggggtactggtccccggtgattggttacacgcaactatcagttggtggcctgtgtttatggttggcgagcgctccttcagcattttattgttgcctttattagttgggacgagtgttcgcgtttataagcagctgccacaaattgcatggcggcagttagcggcccgctatggttgggtaacactcgcgagtgttttggttgcaatcattgcccgttttgcagtgctcagcccgcagtggttgctagcattgatgggattaatcgttgtgctaacttggggaatcttagcacagcaccgttattatgatcgacaccaacagtttcgatattctgatactgaacaaggtgtgcgggtgattgggttacgcccccacacgcccgcggataaattaaatctcgatttaggagatattatcttggaatgtaaccggcaaccagttaatacggaagctgaattttacgcggccctactgaaaagtccgacgtatgttcacctcaaagtgcgcaatcggcaacaggaattaattattaccgaaacggcgatctataatggcgccccacacgagttaggaattgtgttattcactgatcaggaggattaatgaccatggataagattttagtggtagacgacgaaccagctatcgtcacgttattatcatataacttgaagcaggcggggtacgaagttgtgacggcgacggatggtgcggacgcgttgtcattaggcctggcccaatcatttacatgtattttgttagatttgatgttgccgaaactcgatggaatggaagtaacaaaaaagttacgacaagaaaaggttcagacgcctattattattgtgacggctaaaaatgatgagtttgataaagtgttcggcttggaattaggtgcggacgattatataaccaagccgttttcaccccgcgaagtgctcgctcggatcaaagcagttattcggcggacaacgccggacgagcccgtgacaccaccggcacccatgccgcctgctaatcgtgcggtaatgcttgttggtgatttacagattgatcaaaacaaataccgagtcgcgcgcaacgggaaaaatatcagcttgacaccaaaggaatttgaattacttgtgtattttgttgaacgagaaggtcgggttctcagtcgtgatgcgattttaaatcacgtctggggctacgactatgctagtgagacgcggatcgttgatattcacatctcacatttacgtgaaaagattgaagcagatcccaagcagccacggttgatcaggacggtccggggttttggctacgaatttgtgggtgacggccatgcataatcgctggcaacagacgacacggttattgctcatggaaaatgtattactggttttgatcgtgttggtcgtgttgcagcacttttcgccaattaagtggtcctggcgcctagtcggttgtttagttggtgcttggctggttttggcagtaatcgagggcttgatcgcttggcggcaacaaagtgaacggcagcgcacgatcgaccgtatggaagctaagcttcgtcagatgagtagccagcaatttccaccacatatcttattgccacaatcggaccccttatacagcctagcacaagcggtcaaccagttagagagttatcaaaaaagtcagacgcgccgtgcggaactgcaagaaaaagagttaatgatgattatgcggtacttgcctgtgggagtgatggtcattgaccaccggcgacaggttcaactgtctaatccggcgatgagtgaactattgcaagtctcggttaatacggtggcccacatttataccaaggatattcagctgtacgcgttgactaaattgattgaagatacgattactagtggcaaaaatcaacgggcaacgattacgttgactccagcgcctaacacgcaggttgtcgaggcttcaaccgtttatatccaaggcaatcgttcacaatttcaaattgtcctgatgttgtatgatatcactgaagtctatatgattgaacaaatgcaggatgattttgtcagcaacgctagccacgagttgaagacgccgattacagccatttccggtttcactgaaacgttgttaagtggtgccaaggatgatccggacacgcttgaccaattcttgcatattattgcggatgaaagtcaacggttgattgatctcattcaggatgttctgtcgctatcgcgaattcgtgctcagaatacgacgatgttaaccttagttccgcttgctgttcgaccattgatcgaacaggaactggctgtagttcagcaggcaatcgaacgtcagcacttaacgatcaataaccaagtcgatgctgatctaatgataacgagcgattcacagaagttgagtcagatcatcaaaaatctgttaacgaatgcaatcaagtataatcgacctcatggtagcgtgacgattgccaccatggtcagtcatcaaacgtggtcgctgatagttaaagatacgggcattggtatcagtgccgatgatcaacagcgtatttttgaacgcttctatcgggcgagtccgtcacgttcacagcaacttgtgagtgggactggactcggattagcgattgttcaagaattggtcaacgcaatgcacggaacaatcgacgttgtcagtcaacggggcgttgggacaactatgacagttacattgccactagctgcgagtgcttccgagcagtagtaaggcgttaagcatacggacagttctgattgtaactggtggtctatcaaatgatgacgtggtgacggtatgagttgcattgctgagtcaaaagatgtcattagttgagcattgaatgtgtcgtaattaagccagacgaattgataacgatttttaaggtaaatgtaaaccttgaaaatcgttttttttgtgcacttttttaattttcctttcatattgggggctaaaagccggtaataattaaaaatatatcgacgtttacacaatctttacaaaactcatataaagcatttacacaaactttgtattattgaatatgagcaatgggtaggaggtatatagttatgagaaaaagtcgggtcatccaattaatcgtgttaatcgcgatcattggactagttggattagggtacacacatcgcgatcaaactagtgccagtgaatcaattaccgcggttggatcaacggccttacagccactggttgaagcagccggtgaacaatacagcagcaaccataccggtgtgtttatcaatgtgcagggtggtggctctggaacgggactcagtcaaattcaggcgggggccgtggcaatcggtaattctgatatttttgccgaagaacagtctggcattacagcgagcaagttaattgatcaccgggtagccgtcgtcggtattgcccccatcgttaataaaaaggcgggcattaccaatttgacgcagcagcaactcattcagatttttactggcaaggtcacgaattggcgtgaagttggtggacgtaatttaccgattacgttaattaaccgtgctcaaggctccggaacccggaagacatttgagcgatacgccttaaagggtaatcagagtgttgattcccaagaacaagattcgtcaggattagctcggtcaattgttgctagtacacctggcgcaattagttatgtggctttttcttacttagacaactcagtccagaccgtcaatgttgatggtattcggccaaccgaaaaaaatgtgcggaataatcgctggtacatctggtcctacgaacatttatatacggggaagcaccccaatcagttaaccaaaaaatttattgattacattttatcaaccgctgttcagcagaagttagtcaagcagttaggttatatttcggtccatgacatgcaagtacagcggaatgcggccggtaaagtttcagttatgaaatgagggagagcgcatggataaaattcgagaaagcttattaaaaaaatcagttgctagtaaaattgaacggcgtggtaaggccattagtctagtttgtctagcgctaattgtcgggattgtctttttgattttctactttgttgcatcacgggggttagcaaccttttttcaaaatcacattaatctatggcaatttctgagtgggacgcagtggaaccccggaacagtcggaacgaatggacaaccagctgtgggggcactaccgatgattgttggatcgtttttgattacgattctttcggccttcattgccacaccgtttgctatcgggacggcggtctttatgaccgaaatttcaccacggcggggggcgaagattctccggccagttacggaactattagttggtattccatccgtagtgtatggatttatcgggctacaagttgtcgtaccgtttgttcgtaatacgtttgggggtagtggctacgggattctttctgggacctttgtgctatttgtcatgatcttaccgaccgtgacgtcaatgacggcggatgcgctgaattcggtaccccgttattaccgagaagcctcgctagctctagggtcgacgcgctggcaaacaatttataaagtcgtcctgcgggcagccattcctggcatgctgactgccgtcgtatttgggatggcccgcgcctttggggaagctctggcggtccaaatggtgattgggaacgcgacgttgttgccgcataacctagtttcaccagccgcaactttgacaagtatcttgacgatgggaatcgggaacactgtcatgggttcattacaaaataatgcattgtggtcattagccatgatcctgttattgatgtccttagtctttaacttagtcattcgctacattggtcgaaaggggaaattaaaccatgaacgctaaacgcatcgataaaattgccactggcgtgctatacggcgtcgcagcctttgtggtcatcatcttagttgccctattgggatacattctgatccaaggggtgcccaaaatttcgtggcattttttaacgtcgccggccctggcttttgaagcgggtggtgggattggcattcagttgtttaactccttctacttactatttttagcgttattgatttcattaccgatttcactgggtgcggggatctatctaaatgaatatgcgccgcaaaatacggtgactggcctgattcggacgaccattgaaattctgagttcattgccatccgtagtcgtggggctgttcggatacttgttctttgtagtgcagttcaagttaggcttctcgattctttccggggcgtttgcgctgaccgtgtttaacttaccgattttaacccggagtattgaggaagcactcgccaatatctcagataatcaacgggaggccggctacgcgttagggctatcacgttgggagacggtgacgaagatcgtggttcccgctgccttaccaagcattttaacgggggtcgtcttgagtgccgggcggatctttggtgaagccgcagctttaatctacactgcgggtcaaagtgcaccagccttggactttggtaactggaatccatttgatatcagtagtccactcagtccactacgtccagccgaaacgttggccgttcatatttggaagatcaactcagaaggaattatgccggacgcgaaagccgtttcggcgggggcttcagccgtattaattattgcggtattgctctttaacttcttagctcgttggcttggcaaacgcttgtacaaacacttaaccgctgaataaaggaggccgttttgatggcagataacacaatgacgacgacacaacgtaacatcatggcgtttgatcctaaagatcatgaaatcgcgctttcaactgaggatttacacgtcttttatggtaaatccgaggctatttcagagggcgatttacagtttgaacgttataagattagtgcgttgattggcccatccggttccggaaagtcaacctacttgcgttcgctaaaccgaatgaatgaccgtattgcaacggttaagggcaaaattatgtatcgcggcttagatattaacagtaatgatattgatgtctatgagatgcgccggcacattggcatggtgtttcaacggcctaatccgtttgccaaatcaatctatgagaatattgcttttgcactccgccagcgcggaatgaacaagaaacaagacttggatgaaattgttgaacggtctttacggcaagcggcgatgtgggaccaagttaaagatgacttaaataaaagtgcgttagctctgtctggcgggcagcaacaacgactctgtattgctcgggcaattgcaatcaagccagacattttactgctcgatgaaccagcgagtgctttggatccagtatcgacaagtcaaattgaagatactttgttagaactaaagcagaattataccattattattgtgacgcataatatgcaacaagcatcgcgaattagcgactataccgcgttctttaacctcggcaaagtcctagaatactcagagaccggtgagatttttaccaatcctcaggttgatctgacgaatgactatatttccggaaactttggataggaggaccgttcatgagtacaattttaacgaccgagaacttatcattattttatggtaaaaaagaggccctcaaaggaattaacattgattttgatgataaaggaatcacggctttgattgggccctctggctgtggtaaatccacctttttacgttgcttgaaccggatgaacgatctgattcctaatgtaacgatcacgggtgaggtgaacttcaatggtcacaatatttatgcacccacgaccgatacggttcaattgcgtaaagagatcggcatggtgtttcaacagccgaatccctttccattctcaatttatgagaatgtcatttacgggttacggttgacaggagtccatgataaagaacgcttagacgcggcggtagaaagaagtctgaagcaggctgcaatttgggatgaagttaaggaccggttgcatgccaatgcgctatcattgtctggtgggcaacaacaacgggtttgtatcgcacgcgtcctagccgtcgaacctgatattatccttttagacgaggccactagtgcacttgatccgatatcgagtcggatgattgaagaaaccctattgaatttgcgccaggattacactatcataactgttacgcataacatgcaacaggcgtcacgaatttctgaccgaacggcgtttttcctgaatggtgaattaattgaggtcaacgacacgaaacagattttcatgaatccagttaaacaggaaaccaatgactatatttcaggacgatttggttaggaggaaaaaaacatgcgacgactttttgatgatgaactaaacgatattgatgcaaacttcactgaaatgggaatgatggttagcgagacgattgaaaaggcagtcaaggcgtttatcgaccatgaccgcgacctcgcacaagaaatcattgataatgatgctaaaatcaaccaacgggaagttgaactagaacagaaatcatttgagatgattgcgttataccaacccgtcacttctgatttgcgagaaattgtcaccattttgaaagccgtctctgaattggaaaggatggccgattatgcacgtaatattgctcacgctacgattcgggtcaaaggaaatgtgcgcgtccctgaaattgaggcagcgttatcagaaatggggaatcgcgtgcgaaagatggtcgaagagatgttggcagcttacgtcaaaagtgatgatcaggaagcacgccgggtcgcagctaaagacgcaaaagtcggggagatgtatgatcgtattaatgagaagggaatctccaagatggagcgccatcctgagacggtcatcggttccacggattacctgaatgttgcaacttacctaatgcgcatcggggcgttagtaactaatattggtgagtggatcgtgtatttgaatactggtgagattatcgaattgaatccagaaagttctaatttagtgtaactaatcataaataattgcttaaagccggtcgtctagtttgcaaccggcttttacaattagtaagatatggttagataaactgataaggagcgtctaacgatgaaatcaaatacaaaacaaaagttaactaaatctaataatcgcgttttcgccggcgtcctcgggggcattgctgaatatttgaactggaatgcaacgattctacgagtactctacgttattttaaccttggttacccatggctttggtgttttggtatacttagtattaatgacaattatcccaagtaaaccagacaatacgggtttcttcgaacagatgcggcaaagtaccggtactcaagctaaaccgcaagcgcatgggcgcaaagagattcataacgttcatgaagaggatgatccgcgtcactaagattaatggagtgattatacagtgggcttttggaaacgaattttaatcaatacaatcttatttattgcgattgctggcttttttcagagcagttttcacgttgcaagtgtgtggatggctttaattgccagttttgtgcttgcaattttaaacgccgctattaagccgtttttgctgttattatcgttaccgattacgttattgacactcgggctattcagtattgtcatcaatggttttatgcttcagatgacatcctacgttgtgggtaaggccaatttcggcttttcgagttttggcatggcgatggttgtttcgattctcatgtcaattgctaacgtgattgtttccaactttttcgcgaaagacggcgttgatggtgaataaagcgctttaaagtgctaagattagaagatagaaataatccgttttcagtcataaaagtgtggccgcttgaaagggtagcgtaatggcgcgactggacaacgcgggccacacttttttattagtggaacaattaggagggattcttttggcaggaagtgtaaccgttgccgatttggtgaaaaatacgcgcctggatgtgtatcatggcgctgacttattagaaaagaaagatattacaacgagcgacatttcacgtccggggctggcgttgaccggttacttcaactactatcctcgtgaacgagtgcaattgctaggtaaaactgaaaccgcttattcgaaaaatatgagtcatgatgaacgactgatgatttttcgtaagatgtgtcagttaaccacacccgcgttcgtcatttcaacggggttacccgttccagaagaactcgtgcaagccggtgaggaaaatggcgtgccgattttaggaacgaaaatgacatcatcacggattctaagtaatatgacgaattacttggaaggtaaattagctgaacgacaatctgtccacggggtattagttgacatctatggattaggtgtgctgattactggtgattccggtgttgggaagagtgaaacggccctggaattagtcaaacgggggcatcgtttgattgctgatgaccgggtcgatgtctatcaacaggatgaacaaacgcttgtcggtgaagcacccgcaatcttgaatcacttattggagattcgaggtatcggaattattgatgttatgaatctttttggcgctggggctgttcgtcaagataccgacattgaccttatcgtgcaccttgagaattggacgcctgataagcaatttgatagactaggaaatggagaacagaaccggaaattctttgatgttgaagttcctgaaatctcgattccagttaagactggacgtaacctagcaatcattatcgaagcagcggccatgaactttcgggccgagagcatgggctacgatgcgaccaaggtctttgacgataacttgaacaagttgatcaaaacgaattccgtgcatgattctcacaagtaataaggagatggcagtagcgtgaataccgttttaggggcacttaacccaattgcactgcggttaggaccaattcaggtccattggtacggcgtcattattgctagtgccgtcgtcattgcggttgcactagcagtacgtgaaggtcagcgacggggtgttcggcccgatgacatttacgatatgattttatgggcacttccgtttactttaattgcggcgcggacttactatgtgattttccagtggtcatattatcgtcagaatcccggtgaaatcatccgtatctgggatggtggaattgccatctatggtggcttgattggcgccggaattgtggtcattttattctgtcggtcacgctttatcccaacttggctaatgcttgatattgccgcaccaacggtgattatgggccaaggtattggtcgctggggtaactttatgaaccaggaggcttttggtcgagtgactagtctgagtttcttacaaggcttgcacttacctgattggctgattaaccagatgtatatccgtggcgcgtatcggcaaccaacattcttgtatgagtcggtatgggatctattaggatttgccttactgatgctcacgcgtcatcgcacacattggtataagcagggtgatgtcttcttgacttatgttgcttggtacgcctttggccgcttcttcacagaagggatgcggactgactcgctcatgctatttaacgttattcgggtctcacaagcgttgtcagtggtactgttctttggtagcattggcttaatgatctggcgccggcatcacaatccgaataatcgttggtatttagcgggttctggtcaaaaggttgtcgcagaaaataagtagattagagggttatttgaatgatgaaaaaaattgccgttttaggtgctggctcatggggtagcattttggcaaatctgttggatgaaaatggccactcagtgcggctctggtcgtactcaccggcccaagtcacagaattaaatgagaaacacacgaatgagcgatacgttcctgattttaaatattcagaaacgttgactgcttattctaatctaacacaggcgattgatggtgcggatgtaatcttgtttgtcgtaccaaccaaagcgattcgcgaagtggcccaacaagtgactgccgtgcttgccaagacccatcagcggccgattattgtgcatgctagcaagggactcgaacaagagacacacaagcggctgtcgcaagttttggcagaagaaattcccaccgaattacgacaagcgatcgttgtcttatcgggccctagtcatgctgaagaagtggcccgccacgatattacgttgattacggcggctagcgccgatgaatctgcagccgaattagtacagcaactcttcatgaatgactatttccgcatttacacgaataccgacgtggttggtgttgaactaggtgcggcgctcaaaaatatcattgccctgggtgctggtgcgctacacggcctgggctatggtgatgacgccaaggcagccttaatgactcgtggtttagctgaaatcagtcggctcggagtggcgttgggcgcagagccgttgacatttatcggtttatccggtgttggcgatttaattgttacggcaactagtgtccattcgcgtaactggcgtgctggtaatgagttaggtgctggtcaggacctcaagacggtgattgataccatgggcatggttattgaaggtatcccgtcaactaaagccgcttacgagcttgcacagcaacaaaatatcgaaatgcccatcactgaagcgatttatgatgtattatataagagtgccgacattaaggaagtcattctacaattgatgcggcgcgaggggaaacctgagattcagtaggaatttccaaactaatttcactatttttaggaggatttatcacatgtcaaaagttagaaaagccgttatcccagcggccggattaggaacacggtttttgcctgctactaaggcgatgcctaaagaaatgttaccaatcgttgataaaccaacgattcagttcattgttgacgaagctcgtaaatcggggatcgaagacattgttatcgtcacgggtaagagcaagcgtagtattgaagattactatgattctaacccagaattagaggataacttacgggctaagcacaaggaagaaatgctcaagctggttcaagaaaccacagacattaacttgtactttatccggcaatcacacccacgtggtttgggcgatgccgttttaacggctaaagctttcgttggtgacgaacctttcgtcgtcatgcttggtgatgatttaatggaagacaaagtaccgttaaccaaacagttaatgaatagctatgacaagacacatgcgtcaacgttagctgttatgaaggttcctcatgaggaagtttctaagtatggggttatcaatcctgaaagtgaaaaggaaccgggcctatacaacgttaataactttgttgaaaagccatcacctgaagacgcgcctagtgatcttgctatcattggtcgttacttattaacaccagaaatttttgatgttcttgaaaaccaaaaacctggtaagggtgacgaaattcaattgacggatgccattgatacgttgaacaagactcagcgggtctttgcccatgaatttaaggggactcggcacgatgttggctacaagtttggctacttgaagacgacgatcgaatacgggttaactcatccggatgttaaggctgacttgcggacttacatcaaggatcttggtgctaagttatctaaagaagatagcgccgctcctaaaacaacgaagaaaccaactaaataatacttgattaattaaaacaaccgtgaaatctattaagatttcacggttatttttagttaactgctgaataattgcgattcactaattaagctggcacctagtggtcggcttttaatttgaataaatggggcttgccataataataaccttggcgtagtgaaatatttaagtcattcgccatttgatcttcggcatcgttttcaacaccctctagaattaaccggatatcatgttgtaccgcaatgtcgcgccagaattttaattgaatgggaatctcgttttcacgatcttcggcccgaaagttttgcatggcgaatttgatttcttcggccgattcgagtagcggtttaatgtggtcgtaaacgttgattcccgtgccaacgtcatcaatgctaaattgtaggccgttagccttgtacttatcaatttgttgttgcatcgccgccagtgtaaacgtatcttcaccgggttcttctgtgacttcgacgataacatgaaccgggaatagctttttctgagcatcaatgactgcggcagcaatatcatcatttaaaaattgcttgcgattaaagttaattgatactgacccgatttttaatgcaagctcactagccgtagcctttagtaagctgacttgtacatcgatcggaatattatcgaagctttctggtaaggtccaccggtcctgatcagtctcacgatagcgaatcagcatctcgtagccaatcagtgaattattaaatttatctaactggggctgaataaaatagcggtacataagggaactccttagacttgaattaacacgatttgatgcttcctaatacatactataccaaaaaatgaataagtgaaactgtttgacaccatcttttttgcatggtatcgattatcaattgggctaatgatgattgtgctaaactgcttggtgaacaaggcaattttctgaaaatgagtaaaaagtcaattagtggttacctggcaaagctggtatggacgatattatgagaataactgcttgccagcgtatcgctgattggtttttaaaagtagttatgtttcatcatgacctgtatttatattgactagagttatgtatttgcgcagtaaagcggttataatatacctatggttaaataaataaaattataattgggagcaaaatgaaatgaagattgtaattgttggatgtacgcatgcggggaccgctgcggctgcacaaattctgaaggatcatccggaggctacggtcacgatttatgagcgtgatgacaatatttcattcttatcatgtgggatctacctttatctcgggggaaaggtcaatcacttggaagatatgttctattcgtcaccagaaacgttagccaagttgggggcaatggtcagaaccaaacataacgtgttaaaaattgacgcccagtcgaagaccttacaagtggttgacatgactactggaaaagtgtttggcgatacttatgataaattgattatgacgactggttcaaatgttgcggtcccgccgatttttggaatcgatgagtctaaggtcctattatgcaagacctacagccaagcacaggaaatttaccaaacagcccaagacaatcagcggatcgcaatcattggggcgggttatattggaaccgaattatctgaaagttatgcaaatacacatcatgaagtaacgttattccaatcgcatgatcaaattttgaataattacattagtaaagaaatttcagaccaagcagttcagctattaaaagatcatggcgtgaacgtgctattgaatcaccaagtaactgcctttactggtaatgatgatggtgaacttgtcattgaaaccaatcaaggcgattttaatgctgatctagcaattgtcggaactgggtttgttcccaatacagaactgttacgcggtcaagttgagatggataagcacggtgccattatcatcaatgattacgttcagacctctgacccagatatttacgctgctggtgattcttgtgtcgttaacttcaacccaactgggcgttcggcttatacgccattagcaaccaatgcggttcggcagggtgcgttagcgggggccaatgtttttggtaaccagcaacgatatatggggactcaagcgacatcggccatgcaactcttcgatcacacgctggcaaccacggggttaacactggcaatggcgaaattgaatcatattccagctgaacgggtgacttatgagggcaactggcgaccagcttacatgccaagtacggcgaaactgacgattgaattaatttataatccggaaaatcgtaaaattctcggtgctcagttcttaagtgcgcatgaagtggcacagtctgctaatgcgttatcaatcgtgattcaaaatggaaacaccatcgatgatctagcatttgtggatatgttattctcacctaattttgatgaaccattcaattatctgaacctcgtcgcccaacaagcgattgaacaagaacgccaggcaggccgcaatcacccacgaattacggcctatggcgattgggccaagcaaaatgacaaggatttacaataagaagtaagtcttaccatgggttgaattcaagtgaactggcataattttatttatttaaatctcggtttttagtcaatatatggttaaaagctataattgacttcagttgtgtacaaacaagatagtcgacaaatgtaaattttgggggtatattaagcgtcataggaatttaagtggaaggggtctttagaaatggcaaagagttacgacgtgattattattggtgcggggcctgccggcatgacagccgccctctatgcttcacgagccaatctatcagtgctactattagatcgcggaatctatggtgggcaaatgaataataccgccgcaattgaaaattatccgggcttcaaatctgttttggggccggatttggctaaagacatgtatgaatcagcgacccagtttggtgctgaatacgcgtatggtagcgtcgaatccgttgaagatcgcggcgatgttaaaatcgtgacgacggatagcgatacgtttgagactaaggcccttgtcattgggactggttctgaatatcgtaagctgggtgttactggcgaggatacgtatggtggccgcggtgtctcatactgcgcagtttgtgatggagcgtttttccgtaacaagcatgtagttgtcgttggtggcggtgactcagcgattgaggaaggcacttacctgacacagcttgctgataaggtgacggttattcatcgtcgtgaccaattgcgggcacaacaaatcttacaagatcgggcttttgctaatccaaagatggaatttgtttggaatagcaacgtgacggaaatcatcggtgatgataagaaggtcacgggagttaaggttaataataataagactggtgaagacagtgagattgcggtcgatggtgtctttatctatgttggtattaacccaattacgaagccattcagtaatcttgggattactgacgaaaacggctggatcgaaactaatgaccacatggaaaccaaggtccctggtatttttgcagtcggtgatgttcgtaagaaagatttacgccaagttgcgacggcggttggtgaaggcggaactgccggtcaaggcgtttacacttatatcactgctttaggcgacaaagttaacaattaaataaaattaaaaaatgcgtagctgatttaattgagatcagccacgcattttttattggtaaatatagcgttagtcattgtttgacgatgaccaaaggttcgcgaattagtgttgatagggaaatagaagcaattgcttgttagtatacgttgccaggtaaatatcactgacagtatagtgctgggcctgcaattgggtcagtaaccaggcttcatcatgattactagtttcaagcgcatcgaggttgacctgaccatcgacgattattggatacttgacggcgtcgtcgcccacttgggtaatcgtcagttggccgttttgttcaagtacggcccgtttgacgtagcgaatatccgtgataccttccgtacgcaagcgaaacatcagatcgttagcactcatcccatttttgagggccgtgctgacgagtaattgcccatttttaatcaatagctgtggctgtccatcaatcaaacgtttcacgtagcgattgtgatgtgttaggaatcgcaggaccagcactagcagtgtccagatgagaagcactaaaatgtattgtaaaacagtaacgctggtactataaatcatgcccccaacgattgcaccgagaacgtagttttgaacttggtcgagggcgctgattggcgcaaggttacttttaccagatagattgatttgtagaatgatggtcaatagcccgagggccagtttgatcgtcacatcccagtatgaaaacatttattgcccctccttaacataattgattgttgattgaatcggtgtggctttagtcagggtataactgtttccatccgtattgatcgtcacgttatagatatggtcatggactttaatgagcatcccactgctgacagaacttgtattagaccagaccgcggttttacgaacccctttttctttggcgacacgctgcataatttgtgtcacttgtgatttttggttgaaactatttttgattgtctgccattcattaaattgaatgccgacgagcagcaataataataaaaccatgataatgaataagtcgcggtattttaggtctgttttatggcggtaccataaccagctgagtatggcgattattaatataatgatgccgatggctgcgagttggacaagagtatgattgttattttgatggactaagtagttgtatgaataaaaagtcatgatggcctccttataagatttattatagcaagttttgatagtgactgaactaactagcacttcagaatttatgggtattcgcactgatgcgggcccactacgcatttaaaatgcattaattaatggattttcttagtaaattttactttgtaaagtgtgtcaatgttgtatactatttttgtaagcactaacaaatatcggaattggagatggtttttgtgagttggcaggatacttataatacctggaaaaaccaagcgacacttgaaactagtttaaaacaagaattgacgggcatggctggcgatgacgccgccttagaagacgccttttatgaaccaatggaattcggaaccgcggggatgcggggggtacttggacctggtatcaaccggatgaatatttatacggttcgtcaagcaacggaagggttagcacgcttcatggataccttgcctgctgaggttaaggaacgcggggtagcaatcagttttgattcccgccatcattcagaagattttgcgcatgaatctgcgcgagtattgggccaacatggtatcaagtcatacgtttttgaaagcttgcggccaaccccagaactttcatttaccgttcggcatctgcatacttacgcagggatcatgattacggcgagccataatccgaagcaatataatggctacaagatttatggcgaagatggtggtcaaatgccacctaaggaatctgatcttatcacatcatatattcgtaaagttgacgatgtctttgcgattgccgttgctgatgaacaacaattattagctgataagacggaaaccattattggggatgatgtcgatcaggactacttagctaaggtcaaagaagtgacgatcaatcaaaaactagtggatgaagtcggtaaggacatgaagttagtcttcacaccattacatgggactggccggatgcttggcgaaaaggctttgaagaatgccgggtttaaaaacttcagtgttgttaaggaacaagctgtggctgaccctgaattctcgacggttaaattccctaatcctgaatttcctgaagcctttaagatggccattgatttgggtaaaaaagaaggtgcggatgtcttgattgcggttgatcctgatgctgaccggttagggacagctgttcgtcaacctaatggtgagtatgttctgttgacgggtaatcaaattgccgctgtcttgttacactacatcttgcaagcaaacaaggatgccgggacgttaccgaccaatgcggccgcagttaagtcaattgtttcaagtgaatttgctactaaagtagcggcttcatatggtgtcacgatgatcaatgtcttgaccggtttcaagtatattgctgaacaaatcgaacattttgaagccactggcgaacatacctatatgtttggttttgaagaaagttacggttacttaatcaaaccatttgttcatgacaaggatgcgattcaaaccacagtgcttttagccgaagtagcggcttattataagcaacaaggtaagaacctttatgatggattacaagacttgtttaaggaatacggttacttccgcgaacaaaccacgtccgaagaatttgatggcgttggcggcagcgataagattgcggctctgatgactaagttccgaagcgaagcaccaactgcctttgccggctacgatgtcactgggactgaagacttccagagtcaaacggaaagctttgctgatggccacacggcaccaattgctttgccaaaggcgaatgtcttgaagtatcatttaaatgatggcacttggatcgccattcggccatctggtacggaaccaaagatcaagttctacattggaacgctaggtagtacgttagaagaagctaatgataagttagcgaaatttgaagatgccattcaagcgtttattaaagaataaattggttatttagtcagaagttgtacggcccagctgactagccatgctaagtgataaataacgccttacgaaatttcaagttaatttcgtaaggcgttatttagttgttgttcacattagaaattaattcattgtcggatattcaaagttgacggggtcaccgggtaggcgtaataattgcggtttgccatagtaataaccttgtcgaagattaatatcgaagtgactactcaagcgatcatcttcggcgtcttcaatcccctctaagattaaacgcaatccgtattcactactgatggcccgccaaaaatggagcttttgctgaatcttaggatctttgatatcactgcggaagttttgcaacgcaaattttaattcagaagctaatggcaaaatttcttggatactcttgaaatcgttaattccggtaccaacatcatcaagtgaaatttgcataccatgttcgatgaacccccgtaagtgtgggattaacatggtatctgaataatccttaggactacgttcctcagttagctcaacgactaatttagcaggatagagctgaacctgactttgaataatggccttcgcaaccgttgtatccatcaattgttcgcgactgatattgactgcacaataacgaacttttagtccaagaattttagtcgttgcaatgagcagatcagaggtaacttgtgaactaattgcggcaaaggattcaggcagacgccagccgtctggggttagttgtttgattagtagttcgtatccgtaaactgtattgttgagtaagttaagttgaggttgtacaaaatagcggtaaattggttccataagtaccatcgccttttataataagtttaaaatcattgaatcgttttaatatcaaccgaatcgctgtatactctaagtatacgtcaacttaaataaatgtttaacttaatccaagttaaattttaacttttaatgaaagctgtggtcgaaacaatgaaagttgccattattggctgtacacatgcggggattgccgccatgaaacaaatcttgaaatattatccgggcactgaaattaccgtctatgaacggcacgcggatatttcatatatgtcttgtgggacttatctacacttagggggtaccatccataatttggatcaagcgttgtacgctaatcctagtgaatttagtgaacaaggtgtgcagatgcggatgcagtatgatgtgatcaatgtgaatgctgataagcatacaattttggctcaaaatttacagacaaaagaattacaaacggatcactatgataagttagtcatggcgacgggttcaatcactgcaatcccggctattccgggcgtagagaatcctaaggtcatgctttgcaaaacatgtgaacaggcccagcaactctacgaagcagctaaacatgcacaccatattgcaatcgttggtggtggctattcgggggtggaacttgctgaggggtacgtgaagtccggacacactgtgacgttgtttcaacggggcccccacttaattaatgagtatcttgatccacaaatttctgagaagatcgaagacttgttaacgacgaaaggcatccaagttagaaccaatgcacaagtgacggcttttagtgatacggctgataatcgactacgagttgcaaccgctgatagtgaagaaatatttgatatggctgttatttgtccgggggtgattccacaatcagagttattggcgggacaggtcaaccgaacgaagcagggggccattgtaacggaccgttatatgggaacctccaacccggatatatttgcggctggcgatgtgacggaagttaactttaatcctacgaaggaacacgcctatatgccattagtctcacatgcaattcggcaaggtgcactggcaggaattaatatctttgataaacgcttaggtgcaattggtacgcaagcgacgactgggatgttgatttttgatcagaccgtggcttgtgcaggtctgaccttaacggcggccaaagcagctaacttcgatgcccaagcagctttttatgaaggcaattatcggccggactttatgcctaccacggcgaaagtcatgattgagttggtttatgatcaacaaacgcggaaggttttgggtggtcaactaatgagtgctcatgaagtttcacaatcagcaaatacgttgtccgtagtgattcataatggtaatacgattgatgaattagccttcatggatatgctattctcacccaactttgatgaaccgtttaattacttgaatttagtggcgcaggctgcagtagatcaggaacatggctatcgtcggaataattaagtttttgcactaattatggtcagaaggtgctggttgttaaaatcaagaacagccagcttagacccgctggaataagttcagattagcgtaaacttgtgtggtgagtgtgtccgataccgttcttcagttattgctgccaatcggctgggatggtattcaaaacgaatgtgctacgttaacgtttgttccaagtctaacggagtaggatggttcagcgacagtttagcttgggttaagcggtcgttcatctgccactcgagtggtttcctggaagtcagacgaggacgcgcatatgctgacgggcaagaatccaactaactggcatgttttaataataagtgctggtgaatccataaaaataatgagccaaataaggtggccgcctaacagtgggtttcataacctgactgttaggcggccacctttatattatttgaaagcgattggtcaagcatagtcgttgggatcagcggctaggggttggtaagcgtccatttcggtgtcgcggtagtcccaccattcgttaacgtagccgacaaagcccgcggcggtcatggcggtgtccagcagctgataatttttttcttgaagtgcggttcgaggagcgtcacggtgagcagctgccgtgaagtcatcgaaggcagttggcattgttaactcgctaccatcaggatgggccagggtcaaatctaaggtgacgcctttttggtggctgaaattaggattaggctgggcaacaaattctggatcaggatacacttcaaataaacggcgctgggcgctgacgggccgataagcatcccagactttgagccgataaccttgttgtttaaccagggcgcttgccttggcgagtttgtgggccgtgccagtgcgaacaatggccgtggtaaagtcgtaaatcacttgatgagtaaagttattggtggtggcataacgcaggtcaacgatgatttcggggtctaagtgttgaatattggtgaaaccagttaaagcttgatccatagtagggcctccttagaatttagttatgcttattgtatctgattggccgatattttaccgactaaaagggttgtaaatggtgtcaaactttctgctagctttcaatccgggtccctgatatgatggaaagcggtgtaaatttaacaattgattgaagaggtgaggtcgcatggatcgacaaacacgacgcgcaattttaattttagtttttagtgagtttttagtttgtttagggattagtttagttattccggtcatgccgtttattaaaaatgaactgcatttaacggctaccgatatgggaataatgaatgcgttattcgcattggcacaatttgtggcctcacccattattggccgggtttcagacaaagttggtcgcaagcccgtattaacggtagggctagtcttatatatggtctcggaagtactatttgcgctaaccaaccagctgtgggtctttaatatttcccggattgttggtggcttatcagcagcgatggtcgttccgacggcgatggcgttagcatccgatattacgaccaaacgacagcgagctaaagtaattggctggttatcggcggcctttagtggtggcttgattttaggacccggtatcggtggggtattggctggcattagttataagacgccgttctgggttgctggtgcattgggattactcagtgccattgtgctcgtcattctgttgcctgcggatcgtcagattgatcctgatcgcgaagcaattacggccacgacaacgacgaccaatcatccgatgacgcgggcattttggaccgtcccgattattatattatttacgatgattttagtgtcttcctttggcttacaggggtttgagagcatttatagtatttacgtgaatgaagtctttcactttagtctgagcaacattgcgttggtcttgactttaaatggtttgatttcgctcttcctacaggtggcactatttgatacctttgtccagcgttggggcgaacggcgggtcattcgggtgtgctttgcagctgcggcgctctgcactatctggattacgcaggctcattcgaaagttgctgtcatggttgcaacgctcgttattttttcggcattcgatcttttgcggcccgctattacgaccctattaacgaaagcaagtgaggccaaccaggggctaatcaatgggcttaacatgtccttaacgagtgttggcaatatcgttggcccaatcatgtcggggatgttactagatatgaattatcactatccatatctggtggtggccggattcttgattgtttcttatttaatggcatttatgttacgattaccgaaccaggttcattcacatcagcaagtttaacattgcataacagttaagctaatcagcgaaagcgctccgggtttgcgtccccggggcgcttttgttacacttaggccaaattagattgaaggatggtgggctgcaatgggaatgcatcaatattttcagagcttaagtaatttagaaacgattcaacgggccccgggtttttttaagtatcagaatcattcagttgcggcgcattcatttaaggttgctgaagtcgcccaatttttaggtgatgtggaagaaaatgccggaaaaattgttgattggcgagccctctatgagaaggcgctgaatcacgactataatgagcggtttatcggggatattaagacgcctgtcaagtacgcaacgccgacgctacggacgatgctggcggatgttgagcataaattatcacaaaattttgtgcaaaatgagattccagctgagtttcaggcagcttattcacggcgtctatcagaaggcaaggatgaaacgctagaaggccagatattgtcggtagccgataaaattgacctattgtatgagtcgtttggtgaaattcaaaagggtaatccggaaccagtttttagggatatttatcaagaaagtttaaaaacaattgtcgcgtttaaaaagatgactagtgttcaatatttcttaaaagcagtgctaccagagatgttagcggaaccgttcacgcatcaggatcaattacaggcgctgacgacccagattttaacggccgggccgcaatccgattaatggcgaaagtatgttcgatgtgctaaaattaaatgcgatttgaatgtgatagggaagcgcgggcttgcctattttttatggtgcgacagtaagatttagttatcaatagatgatatgaacgggtgaccgtttaaaaggaggactacgtttgattgatcgggtagataataatcattttgacttagtttcagattaccaaccaacgggcgatcaaccccaagcgatccagcaattaaccgctggcattgaatcgggagaaaaagagcagatcttgttgggggcgaccgggaccgggaagacctttacaatttcgaacgtgattgcaaaggtgaataagccaacgttaatcttgtcacataacaagacgttagcgggtcaattatacggggagtttaagaagtttttcccgaacaatgccgttgaatattttgtgagttattacgattattatcagccggaagcgtacgtgccttcgagtgatacctatatcgaaaaggactcggcaatcaacgatgaaatcgataagttacggcactctgcgaccagctcattattggaacgcaacgatgtgatcgtcgtggcatcggtctccagtattttcggtttaggggatcctcacgagtaccaagatcacgtagtctcactgcgagtcggcatggagatcgaccgcaatgatctgttgcgtaaacttgttgatattcaatttgatcgtaacgatattgatttccagcgggggcgttttcgggtccatggtgatgtcgtagaaatctttccggcttcacgggatgaccacgcattgcgcgttgaattctttggcgatgagattgatcgaatccgtgagattgacgccttaaccggtgaaattgtggctgatcgtgaacatgttgcgatcttcccagcgacccactttatgacgaatgatgcgattatggaacacgccatcaagggcattgaagatgagttggacggccgcctgaaagaattgacagccgatggcaaattgttagaggcgcaacgactcaagcagcggacgacctatgatgtcgaaatgctcaaagaaatgggctacactagtggtatcgagaactattcacgttttatggatggccgtaaacctggcgaaccaccgtatacgttactggacttcttcccgaaggactttttgctcgtggtcgatgagtcacacgtgacgatgccccaagttcggggaatgtataatggggaccgagcacgtaaacaaatgctagtcgattatggcttccgtttgccaagtgcgttggacaaccggccattgaaacttgaagaagttgaacagcatattaatcaagtggtttatatgtccgcaacgccgggcccttacgaaatggatcggaccaagcacgtcgtccagcaaattattcgaccaactggtttattggatcctacgattgaggttcgaccgattatgggtcagatcgatgacttagtgggtgaaatcaataagcgcattgaggtcaacgaacgggtctttatcaccacgttaactaagaagatggcggaagatttgaccgactactttaaggatttaggcatcaaggtacggtacttgcacagtgatattaagacgttggaacgaacgcagatcatccgcgacctgcgtctgggcaagttcgatgtgttggtcgggatcaacttgttgcgggaaggaattgacgttcccgaagtttcactagttgcgattttggatgcggataaggaaggtttccttcgtaacgagcgttcgttgatccaaacgattggtcgggcggctcgtaatgagcacggttcagtgattatgtacgctgacaccacgactgattcgatgcaggccgcgatggatgagactgcacgtcgtcgagcagtacagatgaagtacaatgaagatcatcacatcacgccacatacgattaaaaaggccattccagagctaattgcttcgacgaagaccactgaagacgcgggtaagaaggatgacttcttagaaaccgactttgatgatatgactcgtgaacaacaattagatatgattagtaagttggaagaacagatgaagaccgccgctaagaagctcgactttgaacaagccgcaacgctgcgtgatacggtcatggaattgaaagcacaaattagctagcaggttgctggcttgagattgaggaggcctttttttggcaaatgataagattgtcattcacggtgcgcgagcccataatttaaaagatatcgacgttaccatcccgcgcgacaaattagtcgtgattacggggctgtctggctcaggtaagagttcgttagcgttcgataccttgtacgcggaaggacaacgtcgctacgtggaaagtttgtcagcgtacgcgcgtcaattcttaggacagatgcaaaaaccagacgttgattcaattgatgggcttagtccggctatttcgatcgatcagaaaacaacatccaaaaacccgcgctcaacggtcggaaccgttacagaaatcaatgattacttacggttactgtgggcccgagtcggtgaaccgatttgcccgaacgatgggacaccgattgcgagtcaaaccgttgaacagatggttgatcggattcagaaattaccggaacgaacgaagttgcagattttatcaccaattgtccgccagaaaaagggcgagcacaaaaagatctttgaaaagatcaagcgtgaaggtttcgtgcgggtccgtgttgatggtgatattcatgatatcagtgaaacttttgaactgaacaagaatcaacaacacacgattgaaatcgtcattgatcggatcgttgtgaagtccggtgaccgttctcggttatttgattcttttgaagcggcgttgcgattaagtgggggctatgcgattgcggatgtgatcggtggcgaacccattatgttctcagaacattatgcttgtcctatctgtgggtttactgtgggagaacttgaaccacggttattctcgtttaacgcgcctcagggagcttgtccagactgtgaaggtctcggaatcaagctagaagtcgatgaggaccttgtcgtacctgataagtcgctgacgttggctgaaggtgcgttagcgccttggaatccaatcagttcacagtattatcctgaaatgttgaagcaagcttgtgaacagttagaaattccgatggatgtgccgtatgaagacttatcaaaagctgatcaacaaacggttttgtatgggtctaacggaaagacgttccatttccactaccagaacgactttggtggtgttcgcgatgttgacgctgtgtttgagggcgttatcaacaatgttgaccgccgctaccacgaaacgaatagtgatttcacccgcgatgtgatgcgaaagtatatgacggaactcacttgtcagacttgtcatgggttccgcttaaatcgcaaggccctgtctgtcaaagttggtggcgaacatatcgggatggtctctgacttagccattggtaaggaactcgatttctttaacgagttgagcttatcagaacaaagtctcgtgattgctaaaccaatcttgaaggaaatccgcgaccggttatcattcttgcaaaatgtgggactggcgtacttaacgctcagccgttctgcacggacgctgtctggtggggaagcccagcgaatccggttagcaacacagatcgggtcgaacttgtccggcgtgctctatatcttggatgaaccatcaattggattgcatcagcgggataacgaccgcttgattggttcacttaagaagatgcgcgatctggggaatacgttgatcgtggtcgaacatgatgaagacacgatgcgggccgctgactatatcgtggatatcggcccgggtgccggtgaaaacggtggtgaggtcatggcggccggaacgcccaagcaagtggctcgctcgcggaagtcactgaccggccaatatctatcgggcaaacggtttatcccactacctgaaactcggcgtccgggtaatggtaagaagattcgtatcactggtgcggccgaaaacaacctcaagcaaattgacgttgattttccactaggcgaatttgtcgtggtaacgggggtttccggttctggtaagtcgaccttggttaacgatgttttgaaacgcgtattggcacagaagttgaatcgtaattctgaaaagcctggtaagtataagagtgtcagtggtattaagaatattgaacggttagttaatattgaccaaagtccaatcggccgaacaccacgcagtaatccggccacatatactggtgtctttgacaatattcgtgatttatttgcacaaacgaatgaagctaaattacgtggttacaagaagggccgctttagttttaatactaagggtggtcgttgtgaggcttgtcacggtgacgggattctaaaaattgaaatgaatttcttgcccgatgtctttgtaccttgtgaagtgtgtcatggtaagcaatacaattctgaaacgttggaagttgaatacaaaggcaaaaatattgccgatgttcttcaaatgaccgcttcagaagctgttaagttctttgaaccaattccaaagattcgacggaaactacagaccttggtcgacgttggtttgggctatgttaagttaggccaacccgccacgactttatcaggtggagaagcccaacggatgaagttagcttccgaattgcacaaacaacagtcggggaagaatttctacatcttggacgaaccaacgactgggttgcacagtgaagatattcggcgcttgattggcgtcttggatcggttggtggatgcgggtaataccgtgttaatcatcgagcataatttggatgttgtgaagtcggcggattatttgattgacttgggcccagaaggcggtgacggcggcggaacaatcgttgctactgggacaccagaacaggtcgctgaagtggctgaaagttatactggccaatacttgaagcccgttctagaacgggatcgagcacgtgaagcaactgcacctgctaaataacgggcaatgtgctacacttgagtttgtaatgtaattttaatttagaggagttgtttgtacatggctaaagtagaaagttttacattagatcataccaaggttttagcaccttacgttcgtaaaattacggtggaaaatgggcctaagggtgatgccatcactaattttgatttgcggttagttcaacctaacaagaccgctattgatacggcgggcttacacacgattgaacatatgttggctgggttattacgtgatcgtatggatggcgtgattgactgctcaccatttggttgtcggactggttttcatttgattacctggggtgaacatgacaccgttgaagttgctaaggcattgaagtcctcattagaattcattgctggcccagctaagtgggaagacgtacaagggacgaccatcgatagctgtgggaattacaaggatcattctttattctcagctaaggaatgggccaagttgattttatcgcaaggaatttcatcggatccatttgtacgcaaagtcgttgaatagaccaaaatataaaaagtaatggtggtgccggccaccaattaaaaagagcctagcttttcataacgaaaagctaggctctttttgctgtttactgacattgtgcgagcttagcggtcctgaatcgtgggaaaacaatctaagattagattaaggtagtgtttcaaaaataacaaaaaatatactgatttcggtgaatgtctgcataaaaattctacattttagtgaatattgcacaaatgatgaatatatttaaaatattattgaataaaattaaattgggtggtacgatactgtcattgataaaagcaaagataaaaatttcggaggtacaaatcaatggtcaaacaaaatgataaaattattctcgcttattctggtggtttagatacgtcggtcgcaattagttggttgaaggataagggctatgatgttgtggcctgcggaattgatgttggtgaaggcaaggacatggatgcaatcaaagaaaaggccctaaaattaggggctgtttcatcatatatgattgatgctaagcaagaatttgctgaagaatatgcgttaattgctttacaaggtcataccttgtatgaaggtgaatatccgctggtctcagcactttcacgtcctttaattgctaagaagttagtcacattagccaagcaagagcacgctgttgcaattgcccatggttgtactgggaagggtaatgatcaggttcggtttgaggttgctatccacgctcttgcaccggatatcaagatcgaagcgcctgtacgtgattggcactggtcacgggaagaagagatcgattacgctaaggaacacaatattcccgtaccaatcaatttggacagtccttactcgattgacgaaaacttatggggccgggccaatgaatgtggcattctagaagatccatggcagggcgcgcctgccgatgcgtttgaccggacgaaggccttagctgatacgccggatacgccaacgactttggaaatcacttttgaagctggggtgccagttgctttagatggtgaatcacttaacctagctgatttaatcatcaagttggatcagattgctggtgaacatggaattggtcggatcgaccatattgaaaaccggttggtcggtatcaagtcacgggaagtttacgaagcaccagctgcaacggtattgctcaaagcacataaagatttggaagatttgacgtttgagcgtgagttagctcacttcaagccaatcattgaacaaaagcttgcggatacgatctacaacggtctttggttctcaccattgatggaagcgatggttgccttcttaaagcaaactcagcaagtcgtcaatggggtagtccgggtacaactcttcaagggtaacgttattactgaggggcggaagtcacccaactcactatatgatacgaacttggcaacctatacatcagcggattcatttgaccaacaagcggcagttggtttcattaagctatggggcttaccgacgcaagttaatgcccaagtccaagcgaaggctcaggccgaagctaagactgataaggcacacgcctaatgagtaccaagaagctatggggtggccggtttaccgaaacgggtgctaagtatgttgatgactttggggcatcaattagctttgaccagttgcttgccgcagaagatattgctggttcactggcacacgttaaaatgttgaagaaaactggtattttgcctgccgctgatgttgatcaaattgttgctggtttggaaaccttggctgagcgtcaaaaacaaggtaagttggaattttcaacggtcaacgaagacattcatatgaatattgagtcattattgaccgaagagattgggccagtcgctggaaagttgcacacggcccggtcgcggaatgaccaagttgccacggatttccacttgtacttgaagcatcaattaccactaatattggaccggctacatgaactggaaacggtattggtcgataaagcgagtgagaacgtggagacggtcatgccggggtacacgcatttgcaacacgcccaacccatctcgtacgcgcactacctgttagcttattaccaaatgttcaagcgggacatggaacgcttcgagtttaacctgaagcataccgatatttcgccattgggagccgctgcacttgctggaacgacttttccaatcgaccgggaatatagtgcgaaactattaggattcagtgaagtctatcataatagtttggatgccgtttctgaccgggacttcgtgcttgagtttctcagcaatgcttcgatcctgatgatgcatctctcacggttttgtgaagaaattgtcagctggagcagttatgaattcaagtacatcagtttgagcgatcagttttcaacgggtagttcgattatgccgcaaaagaagaaccctgacatggccgaattgattcggggcaagtccggccgggtttacggcaacttgatgggattgctaactgtcatgaaagggattccgctcgcttacaataaggatctgcaagaagacaaagaaggggcgtttgatacggtcacgaccgtgttaacgagtctccacgtcttcaccggcatgttggcaacgctgaccgttaatgaagatcggatggctgatgccacgactaacgatttctcaaatgcgaccgaactagccgattaccttgcaaacaaaggaatcccatttcgggaggcccatgctattgtggggaagctcgtcttggatggcttgaaaaaacagcggccgttgcaggatattccactcaaagaatatcagtcaatctcaccgctgatccaagaagatgtctaccatgatttgaacgcaaaagttgcggtggaacggcggcattcgctaggtggtactggttttgatcagattagacaagaattgcaacgggcacaaacgcaattgtcagcctatcaatctgaaaccactgattaattaatgcttatcaatttgaccattgatattatttttaaagatgacctctaagtggcggagcctcggcatttagaggtcgtttttagtgctatcgacattttgaaaaagcattaagctaacataaagtctatcagaaaaattggaaactcttacattaactggtaagatggaattaatatcggatatgggagatgttgatgtatgtttaatgatcatcgctgggggtttgattggactgaattcatgacggggatcgttttcttgatcgccgcttactttgtcatcaagcaaccacaagcagcacttttaagtttagtctttttatttgccatcgccgcaattattagcggggtcaccacaatcggtgggtacacaaaactacgccgtgaaacagggttgcgggcaaattttgcccttgtgtttgcgattattgatattttagtggggttattatttttattccacgcaccgactggggtactggtactcggttacgtctttgccttttggttcttgatcgattcgattgaacggctaaccgtagtctcacatctacgcgtctttggaaccgggtattttgttctatctttaatcttggatattattagtttggcattgggaatcttattagtaatcaatccaatggttgctgtgattagtttcaacgtactggttagtttctactttgcagtttttggcatcaacgcaatcttgattgcttttgctcggcgtaactagcttggcagtattgactcgttagcgatacttggcgctcactattggtggtgtcagggtgttgttaaggggtcttttttttgcgcgttaatgtaatactgtttggaatcaaatggcgggtcgaagtggcacgtcagtagaaatgacacacccggtgtgttatactaccaacaatatggactagagggggccaatacagcatggcagaatcattacaactagtaattatttctgggatgagcggtgccggtaagacggttgcggttcaaagctttgaagacctgggctatttttgcattgacaatatgccaccagcgttattaccgaagttctcagaattagttgaggagtcgggtaaaataaagaaagtagcgttagtgattgatttacgctcgcgggctttttacgacgaaattatggatatgttggctaacttagacaacacggactttgtgtcgacccggattctgtttttagatgcttccaacgaagaattagtgtcacgctataaagagacgcggcgttcccatccattagccatggaaggtcgcgtcatggatggcgtgcgcaaagaacgagaattattggcgccattgaaagatcgggcttcatacgtcattgatacgtcgacgttgacaccacgtgaattacgcgaatcgatttttgataaattcgaaacggatcaggatgagacttttcatattgaaatgctatcattcggttttaaatacggactcccgattgatgcagatatcgttatggatgtgcgcttcttgcctaatccatactacattcctgaattaaagaagctgacgggactagataaacctgtggcggattacgttatgcagcaaccagctacggaagctttctaccagcagttcttgagtatgctggaaagcattatgcccggctatgaagccgagggcaagagtagtttgacgattgcgattggctgtacgggcggtcaacaccggtccgttgccttgacgcaacgtatcggtgaagcgctggctaagcactacaaggtgcacatcagtcatcgtgatattgagaaacgaaaggaaactgttaatcgctcatgagaaaatacacatttaagactcagcggcctaaaattgtggtgattggtggaggaaccggtttgccggttgttctgaacggcttgcgtaagcaggcagtcgatattaccgcagtggtgacggtggctgatgatggtgggtcatccggcattattcgcaattacgttaacgtggttccacctggtgatattcgtaatgtaatggtggcgttgtcgagttggccggatttgtataaagatatttttcagtatcgtttccagggtgatgatcaattttttgcaggtcatgcgattggtaatttaattattgcggcactaacggaaatgaaatccggggtgtttgacgcggtgcaggaattatcaaatatgatgcaagtagatggtcatgtttacccggcagccaacgaggcactcacgctacatggtaagtttagtgacggtactgagttagtaggtgaagccgaaattaccgcggcccataagtcattggaacgcgtttgggtcactgacaagaatggtaaggaaccacaagcagttcaaccagttattgatgcgattatggcggcagatcagattgttttggggcccggtagtttgtttaccagcattctaccgaacctaacgattggaaatattggtcgggccgtctgtgagtctgatgcagaagtggtttatatttgtaatattatgactcaaaaaggtgaaacggataatttctccgatgctaatcatgtgcgggtcttaaaccgccatttggggcagaactttattaatacggtgttagttaacaccgaaaaagtgccagaagattacatggattttcataagtttaacgaagtttcaaagcaagtgagtcatgacttccgagggttacgtgaacaaaactgtcgcgtaatctcatcgaacttcttgaaactccgtgataatggggcctttcatgatggcgaccaagttgtcgctgaattaatgaatctagtcggtcattccgacgttttcagataagggggtcgtggcatgtcatacgccagtgacgttaagaaagaattgactaacctcgctgtccatcgcgagaatgctaaggctgaattaatggctttgattcgaatgaatggggcgatcagcattgctaatcatcacttcattttgaatattcagacggaaaatccggccatcgcgcggcgtatttaccggctactcaaacaattttatgacgtcgatagtgaattgattgttcggcgcaaaatgaaattaaataagaataatttgtacatcgtacgattgaagaccggtacggacatggtactcgctgatttgggtattttgaaggattatcaaatcgttgaagtggcaccaactgaagtgttaacggatgatgctgcggtgcgttcttatttgcgtggcgcctttttagcgggcggttcggttaataatcctgaaacttcccggtatcatttggaaatttactcactgtatgaggaacataatcatatgatctccgagatgatgaatcagtatggcttgaattcacgaacgactgatcggcgtggtggtttcattacgtacatcaaggaagcggaaaaaattgccgatttcttgtcgttggttggtgcgaccaatgccatgcttaagtttgaagatattcgaatcatgcgggacatgcgtaactcggtcaatcggttggttaactgtgagaatgccaacatggataaggttgccaatgcctctagcaaacagattgaaaatattttattgatcgatgctacggtgggattacaacagttaccaccaaaattacaagaagtcgctgttgcccggttggaacatcgtgaagttagcctcaaggaactaggaacccttgttccgggcgggcctatttctaagtctggaatcaatcatcggctgcgtaaaatcaatcaatttgcggaacaattacaaaaagatgcttagttgtcgataaggatggcttaagcatgagttttgttgaaaagcttgctaaccactttagatggtgttagcggcttttttgggttgaaatggattgattgtcgttcgccatactcgaaaagcacttgacaaaagtaagtgcaactatttatactgaacacatcttattgaaatcggagagacgtaattatgcaaaaatcaacaatgcaaatgatgatgtgctgcccatgttgtgaatcaaacaacatggctatttgcgttgaattacaagcgtctctgcatcaaaaataacgggattgagctcaaatcgttaattttgaaacgcctgcttggaatctgacgagattctgaacaggcgttttttgttacaaccgatgggaataagtagatcaacacatcaaaatgggaatgtaaaggggcgagaagtttgaagaagcgatcagtgttagcagtggtaatgagcctagtattagtgacggtgctggctgcgtgtgggaagcacaatagccagtcttctggtaatggcaagtatgcaagtagtcaggttttaaacttgtcgtaccctagttcattggattcaatcgatatttccaatatgtcgggatatggcagtacgggtaatatttttgaaagcttataccggttaggaaagaatggtagcattacaccgggattagctaagtcaactaaggttttaaaggatggcaagacgtatacctttacgattcgcaatgcaaagtggagcgatggttcgaagataaccgcgcaagactttgtctattcttggaaacggaccgtcaccccagcaactaagtcacagtatgcctacctcttctcaggggtgaagaatgcggatgaaattgtcgctgggaaaaagtcaccaagtacattgggcgtcaaggcgcaaggcgaacatacttttattgtgactcttgataagccaattacttattttaagaagttaatgacctacccgttgtttggaccaattagtgagaaagcggtcaaaaaatggggtagcaaatatgccactaaggctcagtacatgctctacagtggaccgtttaagttgactggctggactggaactaataatagctggcagtttgtaaaaaataatcagtactgggataagaaagctgtccacctacaaaagatcaactacacggtcaatgagagtactacgacaacattgaacttgttccaagaaaagaaacttgatctaacgcaattagcgagtgaacaagttaagaatatgaagagcagttctgactataccacgtacccttattctatcaccgcgtttctggtttataatttccaagacagtaatgcgacaatcaaaaaggcgctcaataacgctaagattcgtcaagcaatttcattgtcgatcaatcgcaagacgttagtaaagaatgtgattggtgccgcatcaacggtctcaaagacgtttgttcctcaggatttagttaaagacgctaaaactgataaggattttgcagatgaatcaacggttaagaattcaacgtcatataacaaagcgctggcacaaaagttatggaaacaaggccttaaggaaacgggaattaagaaattgtccattcagttattagcttctaatgacgaacctaataagccgatttcacaatacttgaaatcagcattagaaaagaatctcgatggtttgacggtcaacttatccaacattccatcaaaggtagcttcaagtcgtgctcaaagtggtgattttgacctttatctcagtggttggggtgctgacttcaacgacccaatctcgcatttgcaaattatgactaataatagtggttataattacggaaaatataacagcagcacgtacaatgcgttggttaacaaggctcaaaaccaggatgccaatgatactagtgctcgttggcaagatatgatcaacgctgagaagacgatcatgaaggaccaaggaattacgccattgtatcagacggtatactcttatttacaaaatccaaaggtaaagggtattattcataatactgctgggacacagtggaattataagtatgcttatattgccaaataattaactgattgagggacgctcatggtaactggtcgtttagctgttaccttagtaggaacgccaggtccatacgtgccttgatcaaaacaaaatagcggtccatttcgacttgtcagagtgtcttgacgaatcgaagtggaccgcttatttatttcgacgaatggttctacagtgcttgagttgtcacgcaagacaactacactgattggtctatgctggtgttacgtcgttaaccacgtacttgattggctgatgttgggccatcgcaatcacattctccgcgacaatggtagccatgccatcgcgagcttcgaccgttgcgttgccaagatgaggtgtcaaaatgacgttgttcatcgtggccaaaccaggtgtgacttgcggttcatgttcgtagacgtcgagtgcagcgccagcaatttgatgttgttgcagcgccgtcacaagtgcttgctcgtcgacaattggcccccgtgcggcgttgatgaggagcgccgtggacttcgttttgctaaaagcagcattatcgattagatgcgttgtttgtgtggtaagcggcagatgtaaagtgacgatgtcggcacgctgtaaaagttcatcctgggagacaaaggttgcgtcaagttgcgtttcacggctaatcggtaggcggtggtgttggctgtataagatgggcatgtcaaaggcgtgtaatcgtttggcaacagcttgaccaatttggccaaggcctaagatgccgagtgtcttgccttgtaagttgtggccgagaaagaacagtggcgcccaaccgttaaagccgctagttcgcattaagtgatcgccttccacgatacgatgcgctaggctgataatcaaaccgaccgttgattcagcggttgcgaccgccgaaacgttcggcgtgttcgtgactggaatctggcgcttagctgctgccgcgatatcgatgttattagtgccagcaccaaaattagcaatcagtttaaggtgtggggcgtggtctaagacatcttgatctacttgagttgagagtggggtaatcaaaaagtcggcatcagcgactcgacggatgagttccgcgtgactgatcaggttatcgccggtataagtatcaatgactaactgactttgtaaaagtaacgtattagcttgggctggaagctgaccagcaataaagacttttgtcattatagagactcctttttacttttaagttcaaggacaagtaatattgtccgggtagtaatccctgcttatgtgcagtatgggctattgcaaaacgaatgacaagaaaacgagcaaaaaaactgggccaacgtcaagttagcccagtcaaagatattagcttattttaatttgttgttttccataatatcatcgatcaaaccgtagtctttagcctcttgtgcgcttaagtagttatcacgttcagtatcatggttcaacttttcaacggattgtcccgagttgtcagctaaaatctggttgatctttttacgagtcttcaagatttcttccgcaacaatttcaatttccgtttgttgaccttgagcaccaccagatggttggtgaatcaagatttcagagttaggtaaagcaaaacgcttgcccttagtaccagatgaagctaagacgctggccatggaagcagccatccccataacgatggtttgaacatcagatttgatgaagttcatcgtatcgtagattgctaagccggcagtaacgacaccacctggtgagttgatatagagatagatgtccttacctgaatcttgggcatccaagaagagtagttgggcaataatggcgtttgccatgttatcttcaatgggaccggataacataatgatacggtcctttaatagtcgtgaatagatgtcataagcacgttcgccacgtgatgactgttcaataactgtaggaactggatacatgatttgttagcctcctaaggttgcattatttgattagctgattgctaatataaatgtagtttaccgctaaggtcagtgaaggtcaaaagaaaaacctcaaaaacagaattccgtttatgcagttaacgtggtatacttaggtttctatcataatacggcttgagattgggtgaacccaatctcttttttttcgacgattttagttagtaggccttggattaagtgttgcgtctaccttggcttgaaaacgatgttctcttataataatgattcaagattaagcagtaatgaacttgcatattcagcactaatgtggtgatttaaaagtagtcgacccgcataattttattatcgcgatagtaggtgaatcaatttactgatagtgacccacaaagatgagtctaatagaagttggaaattcgcacgtgagccgacatattaaacgacttgaccttgttgctggactcaagttgctcgcaacgaattaatcagtatcggatgcatgaatgaaatttaccatgattaaaacgattctataatataataacaattgtagtaattattatttgaatggtgtaagtttagctgttattaaatctactaaacgactacactggtatatggtttacttgaactgattactttttgattatttttacttggacgagcgggtataggtactattactgaccccgaaaggatattacttgttgtttggtttaaattaagttactatatggagatgtgactggtatagtccagtagttgtcacttaaataaatgcacaaaaaaagctgagaatcatttctcagctactgatgcgcccggagggaatcgaacccccatctcaagaaccggaatcttacgtgctatccattacaccacgggcgcctaaacaacatattatattctagcgaataatggataaaaacacaagggttttacataaaaatttattcagggaggtatttttatggcactgggaccaggatttcgccagcaacagcggcaatcacagaagttagcgatgacccagcgactacaacaatccattcagatgttgcagtttaatgtggaagaactaagagattttctaacgcaaaaagcattagaaaacccattgatcgatgtggatacaaattggaataataatcacgccagtttgaacgcagccaaaaatgtaaccaccaaggcggatttcattgagcgtgtgtcgacctctaatcagcattcgttatttgaatacttgttggatcagattcacctaacgatgcgtgatacccatttgcgtcagattgtcctttatttaattgagtacgttgacgtgaatggttatttgcggattgatgagaggcaggttcggcaagaaactaaggcaacgccaattgagttgttggatgcaattaccttattacaacaacttgatccgccgggtgttggggcccggagcttgcaagaagcgctgatgttgcagacagaaaatgatgaccatgcaccgaacttagcctatattgtcttagaagaaagttttgacgagctggttaatcgacaatgggacttgttggctaagaagtatcaggtgacgcttgcggacatttcaagtatttatgattatgtgcgaacactaacacccgtacccggtgcggcaatcgggcaggagacgaccgggtacatctttcccgatttagtggtgacgaatcagggaggccagctggcattgcgaaccgcatccatggctcaaccggtggttaaattccgcagtcggtattatcagcagatggggcagcatgatgatcaggaagttacggaatatttgaaagaaaagaaaagtgagtatgactggattgctaacagtttgcagcaacgcgaggcaaccatttttcgagtgggaacggccattatcgagcgtcaagcagacttcttcttggaaaaaacgacggatttacggccactattgttacgagatgttgcccaacagttaaaagtgcatgaatcaacaatcagtcgaagtattaatggaaagtacattcaaacggacttcggtatgtttgagcttaaacgtttctttaccaaagcggtcagtaaacgtcccactggtggcaaaatcgtttcggccgacagtgttcaacaccgaattgtgaccttgatcgaacaggaaaataaagaaaaaccgctttcagaccaaaaaattgttcagattcttaatgcggaaaatgtcgaactttctcggcggacagtggcgaaatatcgcgaaaatcttaatattccgtcgtcatcaaggcgaaaacaatacttgagaaccgaacgataatttaacgcgccatttggaccagtcggttataagtttaattggggtttcatttgcaaccaccttatgaacctgttataattcatgttgtggtaagagaggtatgcaacattgatttcttagtgaatttgcgttgtgtgctttgttttttgaagtctttgggtcgcttttcgacatagctggaccagacccgtcccactagagagcaggttggatgccatgcattcagatattcaatggattgaggcaattgccccagatatggttgacatgctgagtcgtcgttacttagtattaagaaccattaattggatggccccagttggacgtcggctattagctcagacgttaggtgttagcgaacggacgttacggaccgaaacggatacattgcggaagctagatttgattatgacaaacaaatcgggcatgcaagttacccagcaaggtcaggacgtgttagtaggcctaagtcattttatggatgagctaatgggcattcgccagaaagaacgacagttggcgcaatactttaatattaagcgttgcatcatcgtttctggtgattccgatcgacagttgaaagttattgggaccatgggcgaagaagtgaaccagctattacagcaattattgccggaagggcgtaatattattgctgttatgggtgggcataccatggaacatgtggcaagtcacttaactaataaattaggtgataaacgtgatttgttatttgttccggcgcgtggtggtgttggtgaatcggttgcgattcaagcaaataccatcgcgtcacaaatggcacaacatactggcggtaagttccgctcgttgtttgtaccagaacaggtcagtgaacgaacgtatgaaccactcctcaaagaaccaagtattcaagaggtgctggcgattatcgggcaagctaacgtggtcgtgcatagtatcggtgaagccatttcaatggcccatcgccggaatatgtctgaggatcagatcaaggtgttacgcagtcgtgaagcgattggtgaagcctttggttacttctttgataagaagggtaacgtggtctaccggattccgcggattggattgcaaatcggagaactggcccatcgggagattatactcgccattgcgggtggggcttcaaaagccaccgcaattgccgcgtatatgaagaacattgcacctaaacagacgtgtttgatcacggatgagggtgcggctaacttgattttaaaaaagtaatcttctatagtgaagttgctttttaaaataaaactatttttatttccacaaggaggaaattctagtatgtctgtaaaaattggtattaatggtttcggacgtatcggtcgtttagcattccgtcgtatcttagaacttggtgaaaagtcaagtgatatcgaagttgttgctattaacgatttaacttcacctgcattgttggctcatcttttgaagtatgactcaactcatggtactttgaacgctgacgtttcagcaaccgacgattcaatcgttgttaacggtaagaactaccgtgtttatgctgaaccacaagcacaaaatattccttgggttaagaacgacggtgttgacttcgttctcgaatgtactggtttctacacttcaaaggctaagtcacaagctcacttggacgctggtgcaaagcgtgtcttgatttctgctcctgctggctcagacttgaagaccatcgtttacaacgttaacgatgacatcttgactgcagatgaccgtatcgtttctgctggttcatgtactactaactgccttgcaccattagcattctttgaaaacaaagaattcggtatcaaggttggtactatgactactatccatgcttacacttcaactcaaatgttacttgacggccctgtacgtggtggtaacttccgtgctgcccgtgctgccggtgtaaacactattcctcattcaactggtgctgctaaggctcttggcttagttatcccagaattgaacggtaaattacaaggccatgcacaacgtgttggtgttgttgatggttcattaactgaattagttgctatcttagacaagaaagttactgctgacgaagttaacgccgcaatcaagaagcatactgaaggtaacgaatcatttggttacaacgatgacgaaatcgtttcatctgatgttatcggtactactttcggttcaatcttcgatcctactcaaacagaagttacttctgatggtgacaaccaattagttaagactgttgcttggtacgataacgaatacggcttcacttgccaaatggtacgtactttattgaagttcgccactctctaatatttgattagatagttaagaactttaaaaccgcatatggttttgacggcggggggaggcaaaactcctcttgccgtttttttaatttcagcagtcacgaattctaggaggattttaacattggctaaattaatcgtttcagatttagatgttaaagataaaaaagttttaattcgtgtcgactttaatgttccaattaaagacggcaaaattggtgacgacaaccggatcgtcgctgccttaccaacgatcaaatacgtgattgaacatgatggcaaagccatcttattctcacatttaggtcggattaagagcgaagacgacaagaagggcttaagcttacgtcctgttgcagaacgtctttcaaacttattaaacaagcctgttaccttcgtacctgttactgaaggcgaacaacttgaaactgccatcaacaacatgaacgacggtgacgtcttagttgttgaaaacactcgttttgaagacgttgttaacggcgaacaagttaagcgcgaatctggtaacgatcctgaattaggcaagtactgggcttcacttggtgatgtctacgtcaacgatgctttcgggactgctcaccggagccatgcttctaacgttgggattgcttcaaacatggatcaagttgccgctggtttcttaatggaaaaggaaatcaagttcttaggtgacgcggttgacaatcctaagcacccattcgttgctatcttaggtggtgccaaggtttctgataagatcggtgttatcgatcacttaatcagcaaagctgacaagatcatcatcggtggtgggatgacttatacgttctatgctgctaaaggcatgggcattggtaactcacttgttgaaaaagacaagattgaattggctaagtcaatcatcgaaaaagctggcgacaagttagtcttacctagcgactcaatcgttgctgaaaagtttgataacgatgttcctagcaaggttgttgaaggttcaattcctgatggctacatggccttagatattggtcctaagtcaatcgaagaattcgaagatgttttacgcgacgctaagaccgttgtttggaacggaccaatgggtgtcttcgaaatgagcaactacgccaagggtacgcttgaaattggtaagttcttaggaaccttatcagacgcaacgaccatcgttggtggtggggactcaactgccgctgttaagcaacttggcgttggcgacaagttaacccacatttctactggtggcggtgcttcacttgaataccttgaaggtaaggaattacctggtattgctgctatttctgaaaaataatctgttctccgaaaggaaggtttatcgtgcgtacacctattattgccggtaactggaaaatgaacaaaacagctagcgaagctttagctttcgttaatgctgttaaggatcaattaccagatccatcaaaagttgaatcagtcgttgctgccccagcccttttcttacaggaaatggttgaagctgccaagggttctgatttaaagattgctgctgaaaatgcttattttgaagatgctggggcatttactggtgaaacttcaccagctgccttagctgacttaggcgttgattacgttgttattggtcattcagaacgtcgcggttatttccacgaaactgacgaagacattaacaaaaaggcacacgctatcttcaagaacggcatgaagccaatcatttgctgtggcgaatcattagaacaacgtgaagccggcgaagcagaatcatgggtttcaggccaaatcaaggctgctttgaaagacttatcagctgaccaagtaagttcattggttattgcctacgaaccaatctgggccatcggtactggtaagactgctacgagtgaccaagctgaagaaatttgtgcggttgttcgtaagactgttgctgacctttactcacaagaagttgctgataaagttcggattcaatacggtggtagtgttaaaccagccaacgttaacgaattaatgggcaaagatgatatcgacggtggtttagtcggtggtgcttcattacaacctgattcattcttggaacttgttaattatcaaaataactaataatagttattgcaagttgattgacaaacttctacaataagtgtgaaacaaataacaagccaattttaaggagagaaattaatgtctattattacagatatttatgctcgcgaagtcttagactcacgtggtaacccaactgttgaagttgaactttatactgaaagtggcgcatttggccgcggtatcgttccttcaggtgcctcaactggtgaacatgaagccgttgaattacgtgacggtgacaagagccgtttcatgggcaagggtgttactaaagccgttgacaatgttaacaagttaattgctaaggaaattgttggttacgatgtaactgaccaacgtgccattgaccaagctatgatcaagttagatggtactcctaacaaagctaagttaggcgctaacgctatcttaggtgtttccattgccgctgcacgtgctgctgctgacgaacttgaaatgcctttatacaactaccttggcggattcaacgctcacgttttaccaacaccaatgatgaacgttatcaatggtggggcccacgccaacaacgacgttgacttccaagaattcatgatcatgcctgttggcgcttcttcagttaaagaagctatccggatgggttcagaaactttccacaacttgaaagcgatcttgaacgagcgcggttactcaactgccgttggtgacgaaggtggttttgcgcctgacttgaagaacaacgaagaaccattcgaaatcttagttgaagctatcgaacgtgccggttacaagcctggtaaggatattgccattgcctttgactgtgccgcttcagaattctacaacgaagaaactggcaagtacgacttaaagggtgaaggcgaaaatggtcaatcatttactgccgaagaattcgttgacttacttgacagcattgttgacaagtacccaatcgtttctatcgaagatcctttggatgaaaacaactgggaagactggcaaatggcaactgccaagcttggtaagaaagttcaaatcgttggtgacgacttattcgttacgaacacggactaccttgcaaagggtatcaagatgggcgttgctaactcaatcttaatcaaggttaaccaaattggtactttaactgaaactgttgaagctatcgaaatggctaaagaagctggctacactgccatcgtttctcaccgttctggtgaaactgaagacacgaccattgctgacttagttgtcgcaatgaacgctggccaaatcaagactggttcaatgagccgtactgaacggattgctaaatacaatcaattaatgcggatcgaagaccaacttgaaagcacttcagaatataaaggtatccacggtttctacaacttagacgaagctgcacggaacaccattactagcaagtaatttgaagttctaatgaaaacgtcgttccgatgggacggcgtttttattatacataatttaaggaacatctgtttgattttagggtctagggacggacgagtcgtggtagaatagaaacatgcgtattttgagtaaggagcgagcagaatggatgactttcagcaacaaattaatgagtggtctgattggcaaggactgcaactgaatgccggtgcttttgaaccggtgattcaaaaaatttatgccagtgaaaatgagccttataaaacgccagaacccgttgcggataagttggccgcccgctttacggtcggacccacccaaatcgcgatttttccacccagtgaggttatcccccaaactcgggcctattatcaggcggaacgttttggactgacccggatggctcgattgagcttgggtgctccgcgtctattgcatgcgggcttcatttttgataagtaccagttctactacgtgatttatcagccactacaaggtctgacgctaactgaattttgcgcaacggctaagccccttgctaagtcaacgctggggcgccagattgggacgatgttgacgcgacttaatactgaagttcctgcatttgggccaaccgctgcccaatcaaccgagtgggatatactgggccccgactttgttgccgagcgtacggcctggctacaagtacacaccgtaacgcctaatcaatttgttcatggcaatctagtgggcgagaatttaattgtgactagtggtgaattaggtttacagcgattcagtgccgcccatcaagctgcaaaacaaacggaattagtcccgctatttttgcaagcatttaatgatgatactgacttattggctggatttaaggaaacttatcaaactgacgacttagaaaaggatctgttattaggtttgttattacgcctagatggaccacagcagattcaggcattacatcctggagcgcccgtgacgttagcggccgtccagcaagtgattgcacaacgattatcatgattaagagggggaactcatggtggcacagcggccgcacattgcaaaacaacactttgactttacacggttcagctcgattggccgggcactaattgtcggtgtgattgctgggatcgtggttagtatttttcgtttcagcatcgagcagggactgaggttcgttcaatgggtgtacgcacaaattcatacaaattggctactgctctttccatggataggcttgtctgtggctgtggcgttctttgtgggttggttagttaagaatgaaccgaatattaaagggtctggcattccacaagttgagggtcaattagctggcgagcttgattatagttggtggtcagtgctctggcgcaagtttgtcggtggtattctgggcattggttctggactgtttctcggccgcgaaggcccctcgattcaattgggagctacgattggtcagggtgtcgcgtcgaaactcaaacagacgggatcagatcgacgctccttgattgccggtggtgcagcagctggcctttcagcggccttcaacgcaccgattgccagtacgttatttgttctggaagaggtttatcataatttttcaccaatcatttggaccaccgcattagttagtgcgatggccagtaattttatttcgctcaattttttggccttgtaccagtattacacattccgtacggccataaccttccgttgagtcaatatggcaatctgattgggctcgggatttttctcggtattttcggttatctatatcaaaacgtgacgctgacgatgccaaattggtatgccaagttgcggttgcccagttggttggatggcttggtgccatttttactggtgattccgattggattaatttggccgcagctattaggaggcggcaatgctgttattttgaatttggccgcagtaacgccagcgttactcgccttgttaggaattttcgtgttacggtttaccttttctaccatttcatatggatctggtttgccgggtggcatcttcttgccaatcttgtcactgggcgccatcttaggtgcaatctatgcccagttcatggttgccgttggttggatgccgacgaacttgattccgaactttattatttttgcaatggctggatactttgccggcattggtaaagcaccgtttaccgcaattttattgattactgaaatggtcgggacactacatcacttgatgccattagcagtcgtttcgatgacggcctacttagtcgtggatctcttaggcggcgctccgatttatgaggctttgctagagaagttaattcagccgcggttaccggaacatagcggtatccaggatcggttagaattgccgatctttgaaggctctaagttagagggccatcaagttcgtgattttaaatggccagcagagtcattattgatcgctattcgccgcggggagcgtcaagtgatcccgcatggcgacaccttgatgcgggctggtgataccttaattatcttgactgaccgggataaccgtgcgtgggtgcgccatcaaatcgcacatttaacggtcgcgacgccctgagcactaaacaaagcaacgaattgttcaggatactggaaaaataaggcaaaatatgttaaattgttatagacatagcggaggctttaggaggcacatttcttgtataatttattgttaacgttaatactggttgtttccgttttgattatcattgcggtgatgatgcaaccatccaaaactaatgatgccatgtcttcattaaccggtggtgctgatgacttgtttgccaagcagaagccccgcggttttgaagcgttcatgcagaaggtaaccgtggtattaggaatcgtattctttatcctggcgttagctctagcatggtactcatcgaagtaattgaccgtcctcctgtgatttcaggaggcttttttttaaggtggtgtaatgatgctgaaacaaccggaaccgtttttctttgaacatggccaacatgccgtcattttattgcacgcctatgcgggaagtgccaatgatgtgcggatgttagcacgagcattagaacgggaagattatacagtttatggcccccaattcagtggacacgcgactgatgatccgcgagatattctcgcacagacgccggcgcaatggtggcaagatacgcaacaagcaatatcatttatgcggcaaaaaggctatactaaaattagtatctttggcttatcattaggtggtatttttgcgacggcggccttggagcgtgatcctcagttgttaggtggtggcacgtttagttcaccactatttgctggtaatcgtagtgacgttgctgaaatgtttatcacgctgagtcaccatcaactggcgcacagtcaattctcaattgccgagcgtgaacagatcttaatggtgttgccagaactggttcagcggcaactgcaggcagtcaatacctttaccacgacggaggttacgagtcacctcagcgctgtgacccaacccttcttcattggtcagggtgggcaagatgaattaattgatgcgacggtggcgcgacaattacgtgatcaattaccacaagtaccagttgattttcattggtatgctgatgctggacacgtgattaccgtcaacagtgcgcatcaccaattggaacaagatgttttaacatatttaaaaactatttataaatgaggtaaataatgtcagaagcaaacttacaagaacaaatcctgacttttttgcaagctcatcccgatcgcacgtatagtgttgaacaactaacggatgaattgcattttacaggcgcaacggcgtttacttttctagtaaaggaacttgcgaatatggaacgtaaaaaattagttagtaccgatgatcatgatcatttcaagctggtccaggaaacgaagactgttgaaggttcatttcatggtaatgacaagggctttggtttcgttcgttacgatcccgatttgcctgatatttacattaatccggacaacacgcagtttgccattaccggtgacgatgttgcggttgaaatcattcgaccagcccgtcccagttccgaccgcggccctgaaggtaaaattgtcagcatcgttaaacggaactatacccagattgtcggtgcgtatacaccaagtacggatgaagacgggattattggttctgtggaaattaaggataagaaattatccaaatatcagttattaatcactgatcagggcttacaccccactgagggggaagtcatcattgctgaagtggctgcttatcctgacgctcagcatccaacgcggatgattgggattgccaagcaggtcattgggagtgttgatgatcctgggatggacgtcttacaagtggtctaccaacacgacgtcccgtcagtgtttccagaagaagtgacggatgaagccaaccggattccggattacgtgactgatgaagaaaaagttggtcgggtcgacattacggaccagccattagtaacgattgatggcgccgaatctaaagacttggatgacgcggttgttgcttggcgcttgccaaatgggaacttccatctaggcgttcacattgcggatgttagccattatgtcaccgagaactctgagttagaccgggaagcattcaaacgtgggacgtcagtttacttaactgaccgtgtgattccaatgttgccacggcggctatcaaacgggatttgttccttaaatcctgatgttgaacgattagccatgagttgtgagatggagattgatcaaacgggggaaatcgttaaccataagattttccaaagtgtgattcggtcacacgcccggatgacttatgacgctgttaatcagattctcgaagcccatgaccccaagactcgtgaaaagtacgcggacttggtcgacatgtttgatacgatgggcgacttacaccgtatcttgtacaagcatcggcggcatcgtggtgcgatcgattttgatgataacgaagctaaaattatcgttgacgaagccggtcatccaattgacattcaattacgggtacgtggcttagctgaacgaatgatcgaaagtttcatgttggcagccaacgaaacggttgcaaaaaactatagtcaacttaaggtaccgtttatctaccgggtacatgaaacgcctgatagtgaccggatgcttagtttctttgaattcgtcactaactttggtgtcagtgtcaaggggagttctaaggatgttaagccgaagatgcttcaagacgttttgaagaaggttgctggtaagcccgaagaagccatggtctcagtcatgatgctgcggagcatgaagcaggcccgatacgctgaccagtcgcttggtcactttgggttggcggcaccgtattatactcactttacgtcaccaattcggcggtatccagatatgatggttcatcgtttgattcgccattatgctgaaaacggcactggtgaagaagcccgggcacgttatcgggataacctaccaaatattgcggaaacgacttctgatcatgaacggcgggggattgatactgaacgcgacgttgattcgatgaagaaggctgaatatatggctgatcacgttggtgagacgtttgaagccgttgttgattccgttatgaaattcggtctgtttgttgaactagaaaataccgttgaaggcttagttcatatcagtacgatggacgacgactactacgaatacgttgaaaaacaattagcgttggttggccgtaagacgaaacggacatttagaatcggccagcccgtcaaagttcaactaatgcgggtcgataaggatcaacgagaagtcgactttaagttattgaatcctgaagaagcgccaaagactgatttattgccaaagcgggaacatcatgataactatcgtggtaataaccggcgtggtggcaataacggtaactaccggcgaaatgggaacaataataaccggaataacgaccatcgtggtggccacaacaataaccatcgtaatggcaatagcaatggtcgccggaacaataataatcataatagcaacaataataatcatagtactaacaacaatcggcggtcatcaactgatcgtcggcgttaatttttaagtaaggggatgtgcggcaatggccaaacaacacggtaagcacccagataccgccctcgctcaaaatcggaaagcacgccatgactacgctgttgaggaaacctatgaagctggcattgcgctgacggggacggaaatcaaatccgttcgcgatcggcgggtcaacttaaaggatggtttcgttcaagttcgcaacggtgaagcctggatgcaaaacgttcacattagtccgtttaaagagggtaaccgttataacgttgacccgttgcggtcccggaaacttttgttgcacaagaaagaaatcagtaagctaggtgcagcaacgatgactaagggtgtgacgattattccacttaagatgtatctcaagcatggatttgcgaaagtcttaattggagtcgctcacgggaaacgggaatacgacaaacggcaagatatcaagaaacgcgaacaacagcgtcaaatcgaccgggttatgaaacattactaggcatcgattacgttagcgttgcatcgctgcaccatacaacgagtatggcagcgtcataaaaaggtcttccaagaattaattcgattcttggaagaccttttttagtatgtgttgttggtggttctgtgccgtggacggacgacggcaagcatatattttatatgtactgatgtagtgctcactgttataaatgttctagatactagcaaaatggttatcaggctataaatattttgcgaaaggtcgggtacaagcacttgcgacttagctggtaattatgttagcatataattgtattgatagttaaacgtgctatttattaattgattcaataaatataattgatactaaactttggagaatgttattattctgatattaatcagatttagtataactcaaattgataataagttaattttgatatgatttattgcatggattcttggggggacatgtatgaatagatttataacgagcaagcagcattataaaatgtataaaaagggacgtttctgggtatttgctggtattaccgtggctacctttactctgaatccactgataagtcgggcagatacggaaacgacgaccgcagccaccgcagctacgaccactgctggggcatcctcatcatccaactcacaggttttaaggactactacgactagtacaacaggggcaacgactcagtctagtgcgacggcgattaatgcggcaacaacaaatactagtgctcaaaaaaaacaggcggttagtggcaccactactgactcaaagactgaacaaccggttacggcagtaggagaaaatgaaaacgaaaccagtaatctcagtacctctgattcggcatcagcaagcagtcaggctaaaactggttctggcgacagtttggaccaaacgtcaaacagctcagtaagtgtcgcatcgagttcacagaaagtcacaacacaaaattctgattatcaaaatgatcaaggaacgggctctgagagtggcattcaatctaatgtgacggacacggtggtggctgatgaatcactacaaactaatcgttcaagtgtcgcatcgccaagtactagcacaatggccagtattggtgactcagactcgaaagattctaatgaaactgaaaaagttgtggattcagaaactagtccgatagctgtaactgccacaactaatacaattacgacgactaacgataaagtccagttaaatcgggcactattagcgcgagccgccatacccgcaactgttgtctcaactgggactctgggaacaagtgcctggcagtacacagatgatggtgtgttgacgattcatgctggtgattggaccggagtgggtgatgtcagcgacgtaccgggggattttggcagtgagttaacgaaagtagtgattgatggtccaattaatgcggggactgatactagttatatgttccggtataatccaaatttggccagtattgatggccttgaaaatctggatacttcgaaagtcactgacttttcaatgatgtttatgggaactaagattgctgacttttcaggattagcgcattggaatgtcagttctggtacgtcctttgactctatgttcgccagtgactcgcgagttcaatcttatgatttaagtcagtggcagttgaatacggttcaaccagtgagcttaaaaagaatgttttcatttaacacggccttgaccagtattgatctaagtacttggaatgtgcggatggtcacggatatagatgggttattcaatggagataagagtttaacaacggcggatttacatggctggaacttgttgaatgttacagcgttgtcatcgatgtttttaaatgataccaatctcactgatcttgatataacgggctggcagacgggcagtacgttaactagtactaagtttatgtttgagggaacccctggattaaaggcaatcaacattgcgagtttggacatgtctaactttgcagcagtcactgaagctgatatgaataaggaacctgcagatcatgatatgtttttgaatcaagatagtagcgggaatccgttgcccatgaacctaaacgcattaacggttgggtcaaaaacatatttagtcggtagttcattgccaaacattccaactggaactggctataccggtaaatgggtcaatcaagctgatgccacccagacgtatacgtcgagtgagttaatggctttgtataatggcgtcgataatccagccgatacaatcacttgggtctgggaaactagcccatcctatgctgatttcacgtccaagaatgtaaccggattaattgccgggccgaagacgacgtggcgagttgccgatagtgttgcaacactaaaagatgtgaatgggactgatatttatgcgaccgctgacacagtcgtcaaagtaattagcgtgaacggcgatactgctgtaacgacggtcgacactcaaactgccggtacctatcaagttgacttgcagtatacggatgcgtatggcaaagtatggcagcaaactagtacggttgcggtagcggtaaatcaaggcaaactagttggtaaaccgttggcgatcaaaacgggtgctaagccaacgtatacgattaatgatttaatcgacacggacaactcccgcaatgcggccggcgataagctaagtgctgacgaactcgcgacggctacggttacaggcttggatacgagtaaagctggcgcacaaacggttacgctggcgtatacggatgatgctactggcatggtccacacgacaaccaccacggtgacgatggtcgcaactaaggccgacttaacaatgcgtaatagtactatcattaaaggacccaaaaactcaagttgggactaccgccagtatgtcacgagtgtcactgattttgatgggaacccggttagtttagatggacttaacattgtggttgatcagcaacctgatttaacgcaaattgggtcgcaaactgtcacactcacgtatacggatgcgttgggcaatgtcatcagcgtcccaactcaagtaacagtcgttgcttctcaggcacaagttacaaccaaggcgccgttaacgatttggcccagtgaggttgctcaattaaaagtcgccgatttggtgacaatcacggctgccaacgggaaccccgtcgatactagtaccaacctaacagatgtcacaatgagttcaattgacacgagcaagggtggcgcgcagaccgttactattacttatacggatgaagctggcaatctagtgacagcttatgccaaagtaacggttgaccaatcagatttgaagaccaagctaacgaatccaattgcggggcctaaagctaaatgggactatctagctggtttggaatgggtcaaggatgcaaatgaaaagttgcttgataatctcgcaaccgctgatattaaagtcgttactgaacctgatttaagtgttgcgatggtcggccatgaccaaacggtgacactcagttatacggatgagttgggcaaagaacacttagtcactgcggttgtcaacacggtggcttcgaaggcgaagattacggctgtcagcgaccagatcatcatacctgatgaagccaaaaagctgacggcaaccgacctggtcagcgagttaattgatgcggcgggaaacaaaatcacgaattttgatggtgtgacgatgagtggttttgatgctaaagctatcgggccacaaaccgtgacactgacgtattcggatgcgtatggtaaccaaacaactgattcgacgacagtcaccgtggattccgcaacgctaacgcttcagaatcacactcaagtggcaggacctaaggcgacttggaattatgctgataacatcaaagccatcactgattctaagggccagtcgctaacattaagcgatgccaagattacggtcgtgcaacgtccagatttaagtgtggctggaacttataaaattgtacttgaatatactgatgatttagggcaagcgcacacagagactgccgatgttgaagtgacggcttcaaaagcggccattactgccgtttctaagcaggtgattttggcagaaaaagcgaacatggtaactgcgtcgtcactaatgtcgacactgtacgatgcggatggcgttcaaatttataattttgatgatgtgacgatgagtggctttaatgctaaagctatcggaccacaaacagtaacgttagcgtatacggacgcgtatggcaatcaaacgactgtttcgacgactgtaaccgtggatttcgcaacgctaacgcttcaaaatcacactcaagtggcgggacctaaggcgacttggaactatgctgataacatcaaagccgtcactgattctaagggacaatcgctaacattaagcaatgctaagattacggtcgttcaacatccagatttaagtgtggctggtacgtatccaatcgtgattgaatataccgatgatttaggacaagtacacacaaagactgccaatgtcgaagccacggcttcaaaagcgtccattactgccgtttccaagcaagtaattttagcggaaaacgcgaacatggtaactgcgtcgtcgctagtgtcggcactgtacgatgtggatggcgttcaaattcataattttgatgatgtgacgatgagtggttttgatcataaagctatcgggccgcaaaccgtgacactgacgtatacggatgcgtatggtaaccaaacgactgattcgacgacagtcaccgtggatttcgccacaatcactggtcaagcgacacacccaattgccggtccaaccgcgacttgggattaccgggacagcgtcactcaagtcatcgataccaacggaaagacaattgatgtcgatactgctgacattacagccacaacgcctgatttaactccggcaaaaactggcaagccacaaacggttacattgacctatactgacagtctgggtaaagttcacacgaccgacgtgattgtaacgacggcgctttcaaaggcgaagattacggctgttgctgaccagattatttggcctgatcaagctaaacaactgacggcaacggacttagttgatcgtttatacgatgctgaaggtcatctgattacaaattacgacaatgtcgaaatgagtgcgctggattccaagttagcggggcagcaacgtttgacgttgacttacacggatgttgcgggtaatcaatccgtcgcttatgccaatgtgacagtcgaccaggcaaagctagtgacaaaaccaagcacggtaattgctggcccgacggcaacgtggagttacgaagccggtattagtcagttgacgaatgcagctgggcaacttattaccgtccaaccggggacaattaaagtgttgaacaggccagatctgaatgttgattcagtcgggcaacaacagctgatcacactgatttatacggatgagctcgggaaatcccagtcggtcacggcaatggtgacagctgaggtctcacaagctacgttaacggccaaggcggcagttatcgtgcaaccggatgccgcggcgaagctaacggctaatgaccttgtaacgagcttaacggacgcctctggacaagcggtgactgattatcaaatcgttcagatgtctaagctagacgcgactcggccaggtgttcaacccgtctcattaacttatacggatgcggctggtaacgaagtaagtaccgttgtaaaagtaacggttgatcaggccaagatggagagtcagaaccggactcaaatctggggaccaagtatgacttgggattatcggcaacaattggcaactgttacggattcgcaagggcatcagttgaatcctgatcaagctaaaattacggtcataaccggcccgcaactgacggctaaaatgatcgataagccgcaaacggtcaccttgatgtacacggatgatctgcaacagacgcatactgtgtcagccattttgaccttaacggcatcacaggcggcactcgtgccacgtccggcacagattgtatgggccaaagatgcggggcaactgacgccagccaactttttgcaaacgattaccggcgcggatggcactcaagtgtcgtctttgactaatgtcaaaatgagtgcagtcaatgctagccagcctggtgcccaaacggtgactctaacgtataccgatgattacggcaacgaggtgacaacaactgcccaagtgacggttgatcaagccgccttaacgacccaaaccgctcgaccggttgccgggccgactgcccattgggattatcagacgaactttaaaaccgtgacgaatgctgccggcgaagtgattaatgtcggtgatgctaatattaaggtgttgacaggcccagatttgagcacaggcatggtggggcggcctcaagtcgttacgttcagttacactgatgaattaggattgacccaaaccaccacggcggaggtcacaacagtcgcctcacgggcgcacatgacgactagtgctgaccaggtgatttggcctgcagctgtcggaaaattaacggttgcggatctagtcactggtttaacggacgcctggggtcagactagtcagaattatcaaaatgttacgatgacgaccatcaatgctcaacaggccggaaaacaacaagtcaccctgacatatactgatgaggtgggcaacgtaaaaactgcgactacgacggtgacagtcgaccaagcagcattaacgactcagccacaaatggtcatcgcgggtccgactgccaagtgggattatcatcagggtattggaacgattactgatggtatgggccagccgattgcggtcaataatgccgctattacagtcgtggcgatgccagacttaacggttgcccatattggtcagccacaaactgtgcaactggtttacacggactcgctgggacaacaacaaacggcgttgatccaagtgacaaccgttgccacgcaggctaaaatcagtacgcggccagttaccgtgattgccggccctaagacgacctggtcactgaatgatagtgttgactggtcaacgagtttggcagcggatggcacgttgctgacagcggcgcagcgccaacgggtgactgtagatggtaccctgaacttacggcgggccggcaattacccactgacactaagttacatggaccgtgcgggtaatctgattactgtcacgacgagtatcgatgtattggctagtcaggcccagttacaagtgcgtgatagtcagttgaccgtcggaaacacttgggctgctcaggataatttcgaacgtgcaaccgatgcccagggccaagcactgacattagccgatatcgcggtcgatggtacggtcaacacgcaacgcactggccggtacacattgacttaccactatattgatgttgccggtaatcagttaactaaaacggccgtggtgaccgtcgtcttacctgacgatgatcacattaacacgaccgaccctgataacaatgatcatggtggaacgaccgtacctgacaacaatgatcacggcgaaacatctaaccctgacggcaatgatcatgcaggtatcgctgatcctagtgaaacaccgaagccgagtgagcgacctaacgattcggatggtcataccgtcgactggggcgttgatgatcggattacgacaaagcaacaaccggccgcggctactcgtgcacagactaaggtcaagacgaccgctgagccagctctaccggccaacaatgagcatactagcgcagccaaagcagcagcgacacctgtgacacgagtaactgacacgactgctgacacactgccacagacgggcgagcgcgaccgctcagcacaacaaggcgcggtagtactcggattaacgggattattagggttaatgggattaggacgtcggcggcatacgcatgaggattaagcgtacgattggcgtgttaggttcatcgattagctaaaattgatagcgatttcttgcaacggaccgattcattttgaattggtccgttttgttaactgctgctgtttggacttaatggctggttgcgcgggttgatgaatctagtgtcaagtattcagttaagcagtgattaatgcttgaacaaaattttaaaacataaagagggggtactttcatcagaatctttgctagaaatgactatttactttattttattaagtaaacagctgatgatagtgacatcattaaagctaaattaaaaaagtataaaaaattgaattggtcgcgagacatgaattatgttatattttatgacataccgttccggtaaactatttgaggaggtctcgtcgatgagaaagtggcaagttgcagttgtcatgttgttagcagcgttgggaagctggtttgcgattggtacccaggcccaggctaagacgtatacgattgcgacggatacaacctttgcgccgttcgaatttcaggtcaagggtggtaagtataagggaattgatatcgatattttgaaggcaattgccaaaaaagaaaatttcaattataaattaaaagcgcttagttttggtgccgctgttcagcagcttagtgcgaaccaagttgatggggtaattgccggaatgaatattacggctgaacggaagcagacgtttgatttttcagacgcttactatacttccggggtggtcatggctgtggctaaagatagcaaggtcaaaacgtttaaagatttgaaaggtaagaccgtggcccttaaaacggggacagctggtgcaacctatgcgaagtcgattcagagcaagtacggcttcaaaatcaagtatttcaatgactctaataacatgtataacgatgttaaggtcggcaactcggctgcttgttttgaagactatcccgtgatgtcatacggaatcaagaatggcatcgcgttgaagattgtttccaagcaacacgaggccggcgactatggtttcgcggttaaaaaaggtaaaaacgcggaactgttaaagaaatttaacgcgggtctcaaagcgattaaagcggatggtacttacaaaaagatcattaacaagtacttgaagtctagtgaagcatccttaacgggtgaagacgcaagcagtcggacctttattggcttgttcacccaaaacttggatacgattggctcagggttatggatgaccttggaattaacggttatttcaattattttagcgacgatcctcggactgattcttggggtcttaggcgttatgccgggtaaacttggtccggccatctccagtacgattatttatattttccgtgggatgccattgatggtgttggccttctttatttacattgggttcccagacctgattgggcacggctttaagattcccgcgttcgttgctgggatgattacgttgatgcttaacgaaggggcctataccggagcctttgttaaggggggctttgccgcggtcgacgatggtcaaatggaggcggcccgttcactcgggttgccatactggacggccatgcgcaaggttattatgccccaaggaattcgaatcatgattccgtcgttcattaaccaatttattatcacgctgaaggatacgtcaattctatccgttattgggatcgttgaattaacccaaactgggacgttgattattgcccggaacttcgaaggctttaagatttggttaatgattgcgattatttatctgattatcattacgttattaacatggttatctaactgggttcaaaggaggattaactaagcatggcgaaagtaattgtcaaagatttgcataaaagctacggcgataacgaagtcttgaaagggttaaaccttgaagttcaagataacgaagtagtctgcatgattggaccatctggttctggtaagagtacgtttttacgctgcttaaatgacttggaagttccaacacaagggcaagttgtcattagcggttacgatctttctgacaaggggactaacattaatttggtccgtgaaaatattgggatggtgttccaacactttaacttatttccacacctatcagtgttacaaaatattaccttagcaccgactcaactcaaaaaggaaagtcaacaggaagctgagaaaacggcgcgtgacttacttgctacggtcggcttgtccgataaggcggatgccatgcctaagtccttgtctggtgggcaaaagcagcgggtggccatcgctcgagcgctagccatgcatccgaaaatcatgttgtttgatgaaccaacttcagcactggatcccgaaatggtcggggatgtgttggatgttatgaagaaattagccgcagatggtatgacgatgattgtggtcacgcacgaaatgggctttgccaaggaagtggccgaccgggtcgtctttatggcggatgggttgattcaagaaacggggaagcctgaggatgtattcgaacacccacaaagtccccggttacaagatttcttacaaaaagtgatcaacgtttaagtatcggctggtcataataaaataacccgtcaaataggcgcgctaagaattggtttaattcttggcgcgcctattctgtagtaacgtgcttgcatagcagatgaagcggtgttgctctgaggacgattaactagtgaataccgtgatatgggcaacttgatcggcacgtcaactttgatagggtgttaagctggcaaactagttatgccaacttaactaaaaacaacggtcatcccgaaacaggggtggccgttgttttatggctagttctatttagtgttggggcaccttattacggggtgtcaatgtataattactttcaccaaagctaacattgagtccctttttcgcaactggtgtccgcgcgcggttggtcggcttttgccagtgatccaggatcgccgcaatgcaaatacacagtggttctgtggattgatcagtaattgctaattcaaatgcttcaccgttagtggtgacaactggtcgcatcgtcatgattaattcagtaccatgataaacgcggtagttttcggcactcaagcttcccatgataatccagcgaagcttgcgaacatagagcatttcatgccagaagcccagcgttttactaatagaaccgacgttttgacggttatagtataaatcgaattttggcaacaatccgagggttgtttgtcgaatttcggcaagtagctcaccttggatcgcgtataaactgagcgcgtcttggcgccgcccccaccgaccaactaagagatagtgagattggttgtgcgcatcgcgaacaatccgggcaccttgggcgaagctattgcggctgaaatataatttacgcatcttcaacctccgttttccggaaactattgtttggcaagcacttctaagattgctttgccgacaccatcgttgacatttgtatcagtgatatagcgggccaactgtttgacttcgggactggcattacccatagcgtaacttacgccagctaattcgagcatggagacgtcattattattatcaccaatcgccatgacatcgctcattggggtattcagcatattcgcatagcgctcgactgcaatccctttttgcgcattaatattattgatttcgatatttgatgcggatgaagatgtgattttgagggacgaatgttttgccagaatttcatcactaaggggttttagcttagcgggcccttcttcgctgaaagcgataatcttcatgacatgcttagtcggatcatccaataactcgttatagttgtccacgtaattgatgtccataagttctaagcgggctgacgcgagcgataccgcaattttgaacgttgtatctggattcaggttagttaggagatgtgcaatttgttcgattcgcttggctttactgttagagtaaataccatcgttgcctacgacttcaaaatagtaaccttgtgaggttagcgtgtgaaaaacggtgcgggccacgctattggttatgggcaccatgtcgagcattttgccagaagcgtcgtatacttcggcaccgtttaacgtaatcaagggtgccgtgatgccttgagcggccagtagtggctgagcttcagaaaatcggcggccggtggagacgataaagtgcacgccttgctgttgtgcttgacggatggcattagcgttaaaatcggaaacgaccatttcattgttgagtaacgttccgtccatatcagaggcgataatcgaaatcatgttgtcacatccttagttgttttaataattacattttaacatgtttacgtctgaatacagaattattatcattagtggttttggttatgatacaataaaacgagaggtgttaaggatgaaagcgtttattcacacggactggtgggacgtcttaaaaccagagtttgagaagccgtattaccaccaattacacgaatttttgaaaaatgaataccgaacgaaaaatattcacccagatatgtataatatttttcaggcctttgaatggacgccatttgctgacacgaaggtcgttattttaggtcaggatccgtatcatggtcctggtcaggcacacggactgagtttttcagtgttaccgggcgtggcagtgcccccatcactagtcaatatctataaagaattgcaagatgatgttgggtgtacgcccgtcaaccacggttacttggaaagttgggccaagcagggagtcttgttattgaactccgtgctgactgttcaaaatggtgtggccttttcacacgctggtaagggctgggaacgacttacggacgttgccattcagcgtttatcggaacgatcgacgccggttgtctttatcttgtggggtaaggcggctcggtccaagattaagctgattgatacccagacgaatgtcgtgctacaagcacctcatccgagtccgctttcagcttatcgcggattctttgggtccaaaccattttcaaaaacgaacattgcgttaacatccttcggcgaacagccaatcaattggcagttaccagagcacgtcaatcttgagcattaattaatttattggagggttatcacatggatttatttgagtcattagcacaaaaaattactggtaaagatcaaacaattgttttccctgaaggaactgaaccccgaattgtcggtgcggcagcgcgattagctgcagacggcttggttaagccgattgttttaggtgcaacggacaaagttcaggctgtggctaacgatttgaatgcggatttaacaggcgttcaagtccttgatcctgcgacatacccggctgaagataagcaagcaatgcttgatgccctcgttgaacggcggaaaggtaagaatacgccagaacaagcggctaaaatgctggaagatgaaaactactttggcacgatgctcgtttatatgggcaaagcggatgggatggtttcaggtgcaatccatccaactggtgatacggtacggccagcgttacaaattattaagaccaagcccggttcacaccgaatctcgggtgcatttatcatgcaaaagggtgaggaacgctacgtctttgctgactgtgccatcaatattgatcccgatgccgatacgttagcggaaattgccactcagagtgcggctactgctaaggtcttcgatattgacccgaaagttgcgatgctcagcttctcaactaagggttcggctaagggtgaaatggtcactaaagtgcaagaagcaacggccaaggcgcaagctgctgaaccggaattggctatcgatggtgaacttcaatttgacgcggccttcgttgaaaaagttggtttgcaaaaggctcctggttccaaagtagctggtcatgccaatgtctttgtatttccagagcttcagtctggtaatattggctataagattgcgcaacgatttggtcattttgaagcggtgggtcctgtcttgcaaggcctgaacaagccggtctccgacttgtcacgtggatgcagtgaagaagacgtttataaggttgcgattattacagcagcccaaggattagcttaaacggtcacttagtttgttaaacgagggaaacttcagagcttgtactttgaagtttccttcgttttttctataataagaacagttaatttggatgaggagttggaagaatatggaatcaatcacggtaacgtcgccggaagcaaccatggcaatcggggccaaacttggccaattagtgcaacctggtgatttaatcttactagatggtgatttaggtgctggtaagacaacttttacaaaggggttagcaaaaagcctgggcattcctaataacgttaagagtccgacttttacgctcatccgggaatatcgtcaggggcgactaccgctctatcatatggatgtttaccgcttggaagatggcggtgcggaagatttaggcttagatgaatactttgatggtgatggcgttagtgttgtggaatggtcacagtttattgccgacctcttaccgacgacttacttgcgaattgcaattagccgggacactgatgccgatgaccagcgggtaataaccttcaagcccattggtgaacactatcaacgactggttgatcaattgaaggagtgacaaccatggcagaagaagttgttgatgtacggcctgctgaagtcgcggatgcagcacaattattagcgctactcgctcagctcggacgtgaaagtaatactttcactgttgatgagggcattgaggatttgagcgaaacggatgaacaggcgcaaattgagcgtatcaatggcacaacgaccaacattattttcgttgcgacattagattcacggttgattggtgtgagcaccgtgcaagctagtacggattttagtgcggcgcaaggtgaagttggcgtagcggtacttaaagaattttggggcatgggtctggggactgctttgattgaggaagtcttggattgggctcgtaactatagctcattggaacgcctcgtgttgacggtccagttacgaaatgtgcgtgccgttaagctgtaccagcatcttgggttcgaaaattgtacggcaacgagctatgatgtcgttgacccaaccggcaaacgggttccagctattgatatgggaatctgggtttgaaatccgggattcgctgaactgacggcaaacaggttctgatagtagatgggccggaatttaagcgttgacgaaccaggcctaaccggcgacggcttgtgaatgattggctcatctcccagtcggttgggggaattgataagctgtctacgagtattgataatcggtagtgatgcgtaaacaaaaaagtccagcatcttattgctggacttgcataaatttaattttaaccctgaacgcgaacgaaaggtttgagttgctcagttccaaaagcttgcgcttcggtgagtaaaatgttggcgcaagctaggctgtcatctagtgcattatgatgatgctgcaggtcgatatccagtgcttgacagactgtatccagcttgtgattaggcaattctggatagaaccgttgactggtcttgacggtatccatggataggtactccggcgcgctgatgccgtagtgggcaagcgtattgcgtaacacaccaatatcaaaaggcgcgttgtgcgcaattacgaggcggtcgcgttggaagaatggtgcaatgtgttgccaaacgtctggaaacttgggcgcgtctgcgacatctgcttcatgaatcccatgaatttggacgttccgccagaaaaaatcgctctctggtttgatgagtgtgtaaaactcatcgctgatttggttattacggacaaccgttagcgccagtgaacaagcactgtcgcgtttcgcgttcgccgtttcaaagtccattgcgacaaagttcaaagttgccaccaccgtttctaaagaataggattatcgtacaaagaatctcgttaattttcaagttaatggttcggaaggataatatcgagttccactggacagtgatcagaaccaaaaatttcattatgaatgcgggcgtttaggagctgactgtctaattgctgtgacgtaataaagtagtcaattcgccaaccagaattgttgtcacgtgcatgcccacgataactccaccatgagtaaatgtcggtttggtcaggatagaaatgccggaatgtgtcggtatagcccgctgcaaggaggcggtcaaacttggtccgttcttcgtcagtgaagccggcactatggtgattgctacgccagttcttcaagtcgatgttttcgtgggccacgttaagatcaccacaaaagatcaacggcttgttggcactcaaactgttaatatatgtgagaaaagcatcttcccactgttgccgatagtcgagacgttttaattcaccgcctgaattaggagtgtaacacgtcaagacgtagtagtccgcatattcaagggtgatgacgcgaccttcgtcatcgaattctggtacaccgataccataagttacattgagcggctcgtgtttggtaaaaatcgccgtacccgaataacccttgcgctcggcatagttccaatattgataataacctgggaagtccagttcaatttggcccgcctgtaatttcgtttcttgtacacagaaaaagtcggcatcgagttcattaaaagtcgtgacaaagccgtgtttgacagcagcacgcagtccattaacgttccaagagataagtttcacgtgagtttcagacctttcaagtaatttactcatattgtaacacggcagccactggttattttaatgacaattgaatcagtgcgccgtgattaaagccagacacggcggatagatgtgcgatagggtgacaaagcatgctggtgtctttggttggcctagtttcagcgcgtccgagcgggtatctttggctttcagtgatggcacgtttttccagctaacaatcactggcatgaattggacgctgaatgatttaaatcagtgtgccacggagcaatcagtagtagctaaaagaagattgatgataaaattggaggaatatcgatgttaaaaattggggtcattggtttaggtaacattgctcaaaaggcgtatttacccgtcatggcggcgatgcaagaccagtatgaatttcatctaacgacgcgtaatccggaaaaacgagcacaactagcgacgatgtatgggtttcaacacacccatgcgacccttgaggaattaatggcagttaaaccggcggccgtatttgtgcatactcccacggacacgcatgcagcaatcatcaagcagttgttattagctgggattcacgtttatgtcgataagccagtcgcgactgatcttcaggtggtccaaagtttgtatgatttggctgcggcgcggcacctgttattgacttgtgggtttaatcggcgttttgctccttttaatcagcaattgaaggcattgcctgacaaacggatgttagtggctgaaaaagttcgcgaagtgggtagtcaagatcctgaaacggcggttttcgacctgatgatccacatggtcgatacggggctattcttgttagatgaaccacttgaacacactagtggtcggttgacgacgacggcaactggcgcgttggcgcaagtctatttgacggtgcagacggctcatgagcaattagaagttatcacgaatatgtacggtggggtcaatctggaacaagtgacagtccaaacgacggggcaacgtgcgtctgtgactgatttaagtactaaaaccgtgatgacgacggcaacaactaccacgacggcttttccggattggacaccgacattggaaaagcgaggatttgcaccgctgatccgtgcttttctgacggcggtaacaacgcacggacctaatccagtcgacccaactggcgcaattaccagtcacgcggtgtgccgtcatttattaagtgattaaaaagtgctaaaattaactgataggcttacaaatttcaacctgattatatcgtttcaatagcgtttcaatgctgcggtgcttgatacgtcggcctaaattaaaaacgctatgcggttaaagtgattattaacgtaagtgaattaaatcgaaacacgaaaggaacttttcaccatgaccaaagatgtcttggccacttttccagccatcgaaattaaaaaaaatgaatcactaagtcattatacgaatactaaaacaggcggtcccgccgattacgttgcgtttccaaagtcaatcagcgagacgaaagctctgattacgtttgccaatgagcaaaatttaccactaaccgtgattggtaatgccagtaatttgattgtcaaagatggtggtatccgtggattaacgatcattctcacccgcatgaagcaaattcatgcgagtggcaccaaagttgttgctgaagctggtgccgcaattattgcgacgactaaggttgcttgtggcgctagcttgactggtctcgaattcgcagctgggattcccggtagtgtcgggggtgcgattttcatgaatgctggtgcgtacggcggcgaaatgagtgaagttgttgaaacggtgacggttttgacgccagcgggtcagcttaaaaccctggatcatgacgaattagattttggctatcggcacagtacgatccaggactatgatgatattgtcgtatcggtgacgtttggtctcaagccaggtaatcagaccaagattcaagcgcggatggacgaattgaatacgttgcgagcagccaaacaaccgttggaatggccatcatgcgggagtgtttttaagcgaccaactgggtattttactggtaaactgattcatgatgctggcttacagggccatcgaatcggtggtgctgaagtttctaagaaacacgcgggttttattatcaatgtcgatcacgctacagcgaccgattatatggatatgattcactacgtccagaaagttgtatttgaacggtttggcgtccatcttcagacggaagtccgaatcattggtgaagacgtcgttcaaggttagttatgtcaatttaacaaagggggcaaccactagatgccgattatcgaattagtgattttactggcatgtttagtgctgctgtcgaatgtattgagccactatctagtcgcaatcccggtcagtttaattcaagtcgggctgggtctaggagtggctttattattaaatgtacaggtaaaattgcaaacggattggtttatgctcgtctttattgcgcccatgctgtacaacgatggcagagaatttccaaaacaggaattatgggaactacgcggggcaatttttgcgaatgcaatcgtcctcgtctttattaccaccattctcggtggctttttgattcacgtattgatcccaacgattccgctcgctgttggaatcgcgttggcggccattttatcgccaactgatccgattgccgtgcagtcgatctcggaaggggtcaagttacctaaagaaattttgcacttggtcagtggcgaaagcctgattaatgatgcgagtgggttaattgggttcaaatatgcgttagcagcagcggttaccggtacgtttgtactcggtgaagctgttggggatttcttctatattagtctggtcggtttggccgttgggctggcgctgatcacgatcattcaactcattcgggacgtgttacgacgagagggtatcaacgatatcgtgttcaacgtggtgttacagattctcacaccgtttgcaatttatttcattgctgaagaatggttccacgcgtccggtgttgtcgccgttgttgcggccggggtattatcgcacttgcaaaattcacatgaaagtgaagatgcgccggaattacgattagtgacggaacgggtctggaacgtggttgtttacttattgaatgggatcgtcttcctgattcttggtattgaattgccggcagcaacgcaagcaaccattaaaggcgcgcatacaaatacgtttcatgcggtctttgacgttttaatcgtctgggggattttgttactgattcgggttgcttggacatacgcttacatgttgttcaactggttacgacatcacaagaaggctaaacctagtctcagaattgcagcattgtccggtttatcaggtgtgcggggggccattacgatggctggggtcttcacgattccaaccgtggtggcctcgggcaaagcctttccggaacgtgcgctcgtactgttcattgcggctggagtcatcattgtaagtttagttgctgcggcggctattttgccattgatggcggccaaatcactcccctttgttactcggggatccagtccggatgaagacgacgcggtcttggcagagggaacggatgacggtgatgatagcagtgggcaattgccacagttaacatacaagcaagcccgcatttatatcttacagttagcgattcaaaacattgaagaacatcggcggccagctaaccaacgtgcggcctatgatttgatcttggaccagcagtttcagattcggcgtctagaagtggcgtcgcagactgcggatgagttggcgccaatgctgacagatgaattggaacttcgcttagtggcactgaatggtgaacgggcagcagttagagaaatgattgccaataaacaaactagtaagttagctggacaggtctacttgcggcgtgtcgatcggcgcgaacaacgtttcttacaggcgacacatcgacaggggcttccgacactgcgctcattacggttgttgttgacgcgtgcaatgcaagggattcgactatggttagcacctggcgatagcgaagaattacgagtggcgttgttggatattcagcgtgaggcttctaaagctgctattaaagcgttgtcgcggtatctcaaacaggccaacgttgatgagcaacagtttgatcgccaggctctgtatcacttgatcgttcattaccggaatcgcatcgagaatgcgaaaaatgatcacacgttatcacgtgatgattatgaacaacagctgcatggactacgcatcaagagtcttggtgccgaacgtgcgggtgtacagcatttgttagagagtggacaaattagtttacgcaccgcggcaaagttacggcagttcattaattactcggagaacttattgatgctcaatgatattgaggccgatgaagattagttaactttttagattgtaaatcagtagttctaggttataatgatgttagagtagtattgacggtgaatggttaggtttgcaaattaatcattacttaagcggacgaataagggcaagccttacagggggaaacatcattatgacagaatcagaaattcatgaacgcttcgtggacacttatatgcatattttaaaatatgtcggggacttcgtttcagtgccgacccggccgtataagataacgtttgaggcctacacggttatgcggatgattgcaacaagtgaggagccgctgacgttggtcaagattgcgaaagagcagcgggtttcacggagtgcgattgcacgtcaaatcaacgtgttattagatttgaagtacattgaacagaccacgaatacgcatgatcgccgaatcaagtacttatcgttaacacctgctggccataaagtggaacaggaaatcaccacggcttccgaggaacgttttcatcaatgggtccaagtctatggtgaaaaacgggcaagcgatacgttgcgttatatcaacgatgcggaacaaaaggctaccgaactgggtttcagtggcttcagtgggttgcatgataagcgggggcggcataccgaatatagtgatcctaagacgaagaattagctaatatttagttaataataagaaacaccgtttgaaccgattatcaaatcagttcaaacggtgtttttgattacgctaggacttatccggtgtttgataaggaaccgttggcatcgtgaatcgccaagccgcgtagatgaggagttgaagtaaccacatcatcaagacaaaagcgagcatctttagcgaccacatttcaactaattgtttcacaatgtactgtggcgtaattagtaagtagatggagtgcagtcggaggaatcggccaacgtagacaccgacactagcaaataggaagagtgcggcacagatgataccacgactagcagggagtcgctggaagtgtaaacgttgggtcagttgctgggcaattcggtcaacgccccaggtaccaatgattgtagacaccatcattggcccaaccaagtaagcgaaatcccgccacatcggtaagtcgaagcgcaagagaccgttgatgccatacggcttcaataggctgaggtggaataaatcagtcattaagtacggtgcattcggatagaaaagcaaccaaatgaccgcaatcagccaaaataatagcgggctacgtcggggtgtcagccaaaaactcagctcgatcgggacataagccaaaattgaattaagtaatagaaaatggaacgcgccgtgcaagtcgactgctgcgaagatgaaaaatccccagaatgcgagtcgcacaaaccactgttgtaacctagtcattcagtcacttcccttctagtgttaattttaacagaaatattaatcaagctatattaaataacatcaagcttaatatttattcaaaatctagctaaaaagcgcagaccctgctgaaatcgcaccgcgagaaccgggttgccgtgctataatgtgaaagtaaatgattttcatgaggaggaggactatgactttcaattggagcggtttgttgaccttacaaaactttgtccggctccttgacattcttgcggtatggtttgtcatttatgagctgattgtgttgctgagaggcactaaagccgtacaactgtttcgcgggatcgttgtcattgcgattattaaagctgtgagtgttttgattggtctggacacggtttcgtggattatggaccaaattattaactgggcagtcattgcaatggttattatattccagcccgaaattcggcgagggctagagcatttagggcgtggttccatgtttgcacgtggtaagcgtcagaatgaagatgaagagcggatgattgccgaactagataaagccatccaatatatggccaaacgacgtattggggctttaatgtcaattaagctggacacgggtctcgaggattatatcgagaccgggattgccttagatgctgatatcaccggcgaattattaattaatatctttattccaaatacgccgttacatgatggcgccgttatcattcaagataatcaaatcaaggttgcagcggcgtacttgccgttatctgaaagtaatctgattcccaaggagttaggaacccggcaccgtgccgcggtcggaatcagtgaagtaacggatgctctcaccattgtcatttcggaagaaaccggtgaagtgtcgattactaaggacaatgagctgatgcgggggatgacgcgtgaaaactacttgcggtatttccgccaagtcctattaacgcctgaggattcaaccaagcaaaacgcgcttcaaaattggtttggacgagttttcggaggaggtccccgaaaatgaaaaaatttatgaatagcaattggtcaatgcggctactagcactgctgtgtgcgctggtgctcttcgcctacgttaattcgttaaagacaacgcataacgccagtattttgacgaatagttcatcgaaaacgacattgacatctaaccgtaaagtgaccattagcgcgcccttggagctgaacgtgaatagcacgaagtactttgtaacgggttatcccgaaaatattaaagttacgattgaagggccgtctgctttagtaacaactacagctaacacgcagaattttaaagtttatgctaatttatctaagttggcagttgggcggcacagtgtcaaagtcgaagtcgatggcttgaataaagaattgagttatggacttagtcaaaagtacattcatgttaatattcagccacgacgaacggctacttataaggtcagcgcagacttcaataaagccaacgtagcagatggttatgaagttggatcggcacggctcggaacatcatctgtcaaagttacgggcgccgtcagcgaagttagcaaagtcgcgaaagtcgttgcggtcgttaataccaacaagaatttagagaaatccgtgaaccagcaggctatcattgaagcattagatgccaacggtcaaaatttgaacgttgtcttgacgccttcgaccacgtcggtgtatattcccattacgcaggcgacaacgacgaaagatgtgccaatcgatttgaaagccagtggcaagaccgcggcggacaccagttattcattctcatctgacacgaagtcagtgacggttactggcacgaaggcggcattggcgaagttgaagtctttgccagtcaatgttgatgtgacgaatgttgattcaaccacgactaagacggtcgatgtttcgactagcgatgaggatgggatctcgtcagttagcccaacgtcggtcaaagtaaaaattacagttaaaaatgattaatcatgacacttttgaaatgaggtaaattataatgaaatattttggtactgatggtgttcggggaattgcaaattcaggcttaacacctgaaatggcttttcgtttaggtcgtgctggtggctacgtattgacggaacatgcggaaaacaagagtacgcaaccacgcgttttagttgcacgcgatacccggatttcgggccaaatgctggaagaagccttgattgccggcttgctttcagccggaattgaagttttacgtctcggtgtaattacgacgccaggagtggcctacttagtacggatccaagatgctgacgcgggtgtcatgatctcggcttctcacaatccagttgaagataacgggatcaagttcttcggtggcgacggcttcaagttgtctgatgccaaggaagaagaaatcgaagaattactggatcaaccgaaagacactttaccacggccagcagcagaaggtctggggacagttgctgattttccagagggtaatcttaaatattcacaattcttggaacaaacgattccagatgacttaagtggcattcatttggctgtcgatggtgccaatggttctacaagtaacttagtttcccggatctttgcggatttgaacgtggaatttgatacgatggctacggcaccagatggcttgaacatcaacaaaggggtcggttcaacacatcccgaagcattatctaaattcgtcgttgaaaaaggcgctcaagttggtttagcctttgatggggacggtgatcgttgtatcgcagtcgatgaacttggaaacattattgacggtgacaagattatgtacatctgtggaaaattcctcagtgaacgaggcaagttgaagcaagatacggtcgtcacaacggtcatgagtaacctgggcttatacaaggccttagaagcagctggtttgcacagcaagcagacccaagttggtgaccgctacgttgtcgaagagatgttgaaggacggctataaccttggtggtgaacaatctggtcacgtggtcttcttagactttaatacgacgggtgatggcatgttgactggaattcagttattgcacgtcatgaaggaaacgggtaagaagctttctgaattagccgccgaggtgacgacttacccacaaaagttagtgaatgttaaggttcaagacaagaaagccgctttgaacaatgataagatcaaggcagttatcaaggacgttgaagatgaaatggccggtgatggtcgcgtcttggtacggccttctggaacccaagatttattgcgggtcatggcagaagcgaagaccgacgaactggttagcgcttatgtagatcggatcgtcgatgtggtcaaagctgaagttggcgttgaataattaagtgatcagaccgatcatcaaaaaagtcgttactcctagagtcgcgactttttttgttgccatgaaacgaacggttattgctaaatgcggttaactggcgactgtcaggggacccagtgcctcccaaaccaatttgaccgcaaaaaagttacaaaaaattcgaaaattcgtgatgcccttgatttatcagcgtttgagattggtatacacgctaactaacacgtataccaatataatatattgttgacttttattagatgtaacggtaaagttaacttgtttctaggaaatataccaattggaggttagactagaccaattgttaattggttaaagcggaatagcgccaggactttagaatctaaagttgacgaggatgacgtttatcgataatcgacgggtgacgtcagggactgcactctacaggtcaattacaaaaatcgactgtgaggttggtgacagatatattgaccacgcagctagaaacaattcaaacagtaaaggaagattaatttatgtgtggaattgttggtgtaacgggtaaagatagtgcagtatcaatcttattgaacggattggaaaagttggaataccggggctatgattcagctggtatctatgtcaatgatcaagatggtcatgactatttagttaaggaaaagggtcggatcgatgacttacgtaaagaagtaggtgaagctgttcatggttcgaccgggattgggcatactcgctgggcgactcacggtgaaccgagtgttgccaatgcgcatcctcaagtttctgcggatggccgcttctacttagttcacaatggtgtaatcgaaaactttgaagacttaaaacagacttatttaagtgacgtgacttttaagtctcaaacagatacggaagtcattgttcaattagtcgatcggtttgtcaccaaggaaggcttgagtacgttggccgctttccgtaagacgttaggtctgctcggccattcttcatatggattcttactgatggataaggaagatcctgacaccttatacgtcgcaaagaataagagtccattattaattggggtcggcgaaggctttaacgtggtctgctcagatagtttagcgatgttagaccaaacgaaagatttcttggaattacatgatggcgaaatcgtggtcgttaaacctgatgaaattaaaatcacgaaccaggccggtgaaccagttgaacggaagccattccatgtcgacattgacgcagctcaagctgacaagggaacttatccattctacatgttaaaagaaatcgatgaacaaccgaatgtgatgcggaagctatcccaagtttatcttaatgatgcgggtgatccaatcatcaatgatgacttgttaacagctcttaaagcagccgatcgactatacattgtggctgctgggactagttatcatgctggtctggttggtgcaaagttatttgaatcgttggctaacgtgccaactgaagtgcacgtttcgtcagaatttgcatacaaccaaccattattatcagcacatccattcttcatcttcttgacccagtctggtgaaactgctgatagtcgtgaagtgttattgaatgtgaacgatcaacatttcccaagcttgaccatcacgaacgtgccaaactcaacgttatcacgcgaagcaacgtacacgttgttattgcatgccggcccagaaattgcggttgcttcaaccaaagcctataccgcacagattgccttacaagccatcttggctaaagcgttaggtgtggccgttgaccaaccagctgcaacagctttcgacgtgaaacagcagttggcgttagtcgctaatgggatgcaaagcttagttgatgaaaaggctacttttgaaaagattgctaagagtgccttattgaatacgccaaacgcattttatattggtcggggactggattacgccgtctcattagaaacggccttgaaactcaaggaaatctcttacgttcaagctgaaggtttcgcatctggtgaattaaagcacggtacgattgctttgattgaaaaggataccccagtgattgggattattacgcaaaagaataccgctgggttgacccgctccaacttacaagaagttgctgcacggggagctaagacagttactatcgtcaccgatagtttagctaaagatggtgacacggttatcttgccaacggttgatgaacgattaacggctttgcttagtgttgttcctggtcagttattggcctactacacgagcttaaacaagggcttagatgtggacaaaccacggaaccttgccaagagtgtgaccgttgaataatttaaagtaagtgtgtgggcaccaagaaacgtcaccgttcgattacggtggcgttttttgattgcccacaaagcttttgcataatttttaactactaatattcataagactattgtgaaagttgacaatcttttggtatgataaagtaagcggttgcgataacacaactaaataattagactattggggatgaatggtcatgctgaaatataaatattttgcacagccaattaataaccttggaaccaaccgaacaatcttgtatgagttattattacgacagtgggatgagaggcaacaaacttggcgaataccagcgacctttgaaatagcgccaacagaattgattcaattgctggattgcgctattcaggaattaaataaccatcatgtttccatcaatttaacggcgcgtcagtttgctaatcctgactttcaagctgcaattagtcactatgtgcagacgcatttgttaccacgagaactaactgttgagctagttgcgacacctgagctaagtgagttacagcaattaagtgttgggtaccgggcagctggtatattacttgcttttgatgatgttggttctgataacctattccaacagatcaaaatgatgttgccatatgtgaatacggttaaattcgcgttacaaaatatgcgaccgctggggaccccaactacggatgcaattgtttcgacgctcaaattttggtttgataaggcggaggaacagcaaatgctatttacctttgaaggcattgaatcagcggctgatgttcaactggctaatcatctaggcattacgcgagggcaaggatattattttgccaaaccgcaactacccgcgacatttatggcatgacaataatggtatgctacaatagtattcgtagcaatgtaactgagtgccatgttgatgtttaatcggctgaatcacatgacgagacgaggccgattttgttagtaaatgataaaagatggggtggctacttgtggcaatcaatttaattgcaactgacttgaatggaacattattgcatcaagatcagcgttttgacaaagaacggtttaaacgggttttggcgcagttacgggcgataaatgtttccctagtactttcgtccggtaaccaatatgcccatcttagacagttatttaaagatgttatggcggataatcttatcgttgttgctgaaaatggggcgtcgatttatgcccaggaccgcttgatctttgatggtagtctttcagcagaccagcaacgaaagtttgtgactgttgatcgttaccagccactattcaaagacgcatacgtaatcttagttggtagccatgggtcgtatactgagttaggagcacctgataagttagtagcgatggcccgtcagttttatgatcatttacacttggttgcggatctggccactgttgatgataccgttaaaaaaatcagtatctcaacgtcaccggaccaggctgctgatctggtggcacgagctaatgattattttgatggcgagttacgtgcgcatgatagtgggtatggcgtcgtagatttggttgatcagcgggtcggaaaattaccagcaattcaattcttggcgactaaacttgggttaactgcagctaatgtgatggccttcggtgatggggcgaatgatgtcccattattgcgatatgcagcgcacagttatgcgatgtgcaacgcaccggcggacattcaagccgcagcaaaacacgtgacggccctggataatgaacatgatggggtattagcaaccattgaacaagagttgttaaataattaaaagcctataactagtcagtaaaaagctgagctatcgaatgaacatcgttattcgatagctcagctttttgggtcctattaaagtgattgattagggtagaagaattgatgaatgccataagtgttgagcgaaactaaacgctgctttagttcagccaaagatagtcctaaatcaccattaaaatagagccggaaaaaggttaaattgttgtggatcaaaaagcttgaacagaccttagcatcgattgcagataaatgatagtttgtttgaatcgtcgttgtaagccctgctaccacggcagcgtggattttccgagacaaaaaactgtaatcatcattcaacaaaatgactcggtgaaaagcttcagattggcgaaaataggtcactaagcgatcaaagattaagccgggttggctaatgtttttcttgaaatcttgcgggtcaatgagtgctagaatcttatcagcaccttcttgaacgaacgtttccgctaaatcgtcaatggaatcgaaatgtaaatagaaagttttgcggttgatattagcgacacttgtgagctccttaacagtaatatcacgatagcgcggatactttaaagcaagcgtccgaaaagcctctttcagcgcagtctgggtgcgctgaacacgtaagtcagtagctggcataatctgatcctccttattaattacatttgatggggtggtcattattaaaccgccgctaaatgtactagtcgttaagccacatgtgggtattattatcataatagcacttattttgatagttaactcgtcctgagtcatgacagattaactcgcgcaacgtgcataatagcatatgcgcctagtaggtaaatggtaatgaggccatgtccgtcgactaaaatgggttaggagattttcgttcagtcaatggtatggtgtaacgcattattagtgagtcaaaaaagctcccagtagtttgcattctgggagatcaatttgaatcattcttgagtggttagacgtcgtaaatattagaaaaacgataggccgtttggtaggttacaggaatattaggttcgataatgatactgccaaattccttgtggtgaatagcatccggtaatttttgtgcttgcagggaaagaccaagttgagaacgcatcggtttaccgccattgagtcgataacgatcatcacggtaattagttgcactggaaaccacgactgccggagcgttcgttcgcatcgtgactttgcgtccactgatgcgatctagtaattctacttgtggatatggggtgtcgtttaagacgaagccgtgatggagcccgcccttgatgttagcaatctggggcccaacctcgactgggtcacgaaaatcaaatggggtgtcggtgacccatggcaacttaccagttggaataccgtgtttgtttaacgcggcgtactcgtctgcattgattttaagaacatggtggtcaatgaggcgttccgcatccccacttagattgaagtaggtatggttgctggggttgaataaggttgttttatcacttttaccagtgtagctaatagtaaatttaccgtcgttatctaatacgaaattagccgtgatcgtcattgtcccgggatagccgttctcaccgtccaaggtaatatattgcatgacgagtccaacttgatcactagtgtgcagtttacgttctaaaaaccatggttcaaatgaaatttgaggcatattaccaccgtttagatgattttcgcccgcattttgagttaagtcatactgccgccaccgggcatttttgatgatccccgcaacccgagcgatggttgcaccgaaaaaagattgataggtgatgtagtcggcgccgtcgtcaaatcccaagacaatatttgcaaaattaccatctttatcatgggttttgatcgcggtgactgtggcgccccagtccataatagtgacgctcatatgatgattgttcactaatgtataataattcatcccgttcccctgatgctcgattattttcataatgccctcactcccatagctgcctgacatgttaccgcctacttttagtatatttcattcttaaagggaatgcgaataataacccagcaagtgttaatgcgagagtgacagggttagttgctagtgaggtcaatttaaataaccagtgtaaataattataattgattgttgataataattaaaattatctaggttgagaagtttattttaaatcttggtaattgtgaatggtaccaatctattaaataaggtgaattaattaactttgtgcaagtaaagacggcaatttagtggcgaacatggctggctgagggtgttagaaaaagattaatgagtaaatagaaataatttatctatttattttggctaactgttgacaacgcttacaatatcgcttattcttagtttgtaaggtatttaattaccttctaatcaattctctttctctcttatgccgaccactatctgcttggatagtggtttttttgagtgaaattagcgaatttatggcggaatagatgaagataaggctctcttgtaatttttgaagattgatgtttactcagaaaaaggagtgctcggctgatggtagcattttggggctgactgagttagtttagtgttcatcaagtacaggtgattaggcataccaagcctgatcacctggcaattactggtcagttttgacacgactgccaaccccgcttatactaaaatgtgaagtgagggattgcagttgaaaaaccatgaagtattagacttaattcaagaaataacacgtaatgatgggacctcatacatggagatcggaaacatgttgatgaatggccgcgctgagttagcagctgaacgtggttttattaagcaagtgcggatattacaactaaacattccgcattccacgcatgttgccaagtatgagcaatatattaatgaaacatttacgattcccgatgaaacgatggatcattgggaagaatggacaaaaacacctgacatgcaagctgaggtcgatctgattttgaaagaaaatcatattggctaaaagctgttagccaaagtctagcgcaggagtgtgagtttatcaaacggcggttgttttttagtaggcgttggctcaaaagttgaactttcagaatgtcaattctctaagctcagcttttttgttttgatcatgtaattgactgattgtggtgatttaattgcgggtgcgtggtgggggaaaataacttacaaacgctagtatcagtgttattatcaataagcatgtttaaggaggctcgttattaaatgaagaatggggcattgctacaatttattcaaagtcatttccagacccgttttcgttttcgtaacgcgtttgagacccaattgactgttcagattttaagtcgattaattggcgaacatccggaaagtttgttattgactcggcgagatgttgaagcgttggcaggctgctcattggacgcgccggcactacagcgagaatattttccgcagcgtgcgatgacactgttagaaacggcgttagatgagctggttacgttaagtgttatcatacaccaggatcagggcaggacccgttatcccttatttcggagcgtacagcttgatcaagtgtgtcaacgaattgtgtttaacttgaacctggacgtgttgccacaattaacggactggtcacgggaattacaacaagaacaggagcgattttaagtgacaaagagtgtgattgaaaccttacaggaccatcgaacgcggcgacaatttaccactgaaccaattagtgatgcgcaattcgcgcaaatcatcacaacggcacaacaaatgccgactagccaatatttacaggcatacagtttgattgagatcactcagcctgcactacggcaacaattggccacgattacgacgatgccaacggttggtgaaaacggccgtttattagttgtggttgcggaccaacaccgcaacgtcaagctagcaccgggcgcaacgacgcgtcgggcactgagtgaatttgaccgctttgctggtagtattgaagatgccacgctgattacagcggcgatggtgatggtcgctgaaagcatgggtcttggtagcgttgtacttggatcaattaacaacgacacgcaggcggtgattgacgcactgcacttgccggacttgacgttacccgtctttgggttgcagttagggcacccagcggatgttcctgaaaagaaacctcgattagggttgcccgctgtgttgtttcaagatacctatgctgagcctgcgagttatcaggcggagttggaccggtttgatggcgttttgaatcagtattatcaacatcggagtagtcacgcccgtacggaacacttagcgcacatgacgcaggaagcgacccactcagcggccaaacggcgagagtttttgacaatcgctaggcagcagggctttttgccggaattagaccaataatcgttaccataacactaataattagaatggctgagcgaaaaataaccgttaatgtaacgctcccatgtcgctattagctgacatgggagattttttggtacctgggaggacgaatcttaacattaaaataagattaaatattgttatttttactaattataatataattaattctgagacgatgtttactaagcaggcccgggctgcgttgcagattcgagtgaaagctgagtcgatccttattctgatgtgtgatagtaacattgttgcaaggcttgaaaggggcggataatgtgatcaatgccaacttcagaaaactcgtcttagggcgagcagtgggtaacgctggtgacagcatctacatgattgccatgaactggttcattctccaattgaccaacagtgcgttgtggatcggcatcatgaatgtggctattgttttaccgggcgtgttgttgtttctgtttggtgacagtatcgaccgacattctaaacgccgattattagtcgcggttgaattttcacagttagtgatcgtggtcatgctaattggattagttgcgttacatattaagttgccaggtatctatgtcgggctggtattcgtcgcggccctttttggatcactagcttatccgattcaagatacattagtaccgctgctcgttgagccagaccagctagttcaagcacaagcggacatgtcaattgcctacaagggaacggattacgtgttcaacgcgctgtcaggatttttgatcagcctctgctcagtgctcggtgttttaatcatggatgcagccacgtttgtcgttaccgttgccacttttaggcggatcaaactcgctgaaccccgtcagcaacacacccgggaaaagtccttgtatctcaaccagattttggttggtttcaaaattatcagcactgatccgctgctgcgtttattgacgtttgcgagcgtcgtcatgaatttcttctttggcggtttgaatacgtacgtcgttttatttgggcggcatttcggtggctcgatctactacggtattttggagtcgatgtcagccgttggaatattattagggatgacggtagtctaccgacagttaaaaaagttgaccgttcggcagtcttacctcatcggcaactttgggcgcgcgttattcatgatcttgacagtagtgtcgtacaaccagttctggctgtttgccatcatttacttactgagctttgtctttcaaggactgacgcaagtatttgagacaccgatgattcaatcgacggtcggttcagaccaactcgggaaggtaatgacctgcttttatacgctggtttccgtgaccttaccgctgggttcgctagcgttttctttcctagctgaccgctttgatttacggctattcttattactatttgccctcttttatgccggcatattcctgctatttctagccagtcacgccttcaaaaaagtagacgaactacaattatcataaaccccacgcgatattcattaatctgtcatcaatcatgattaaaacgtgccgattaggtggatttctgttcgtcagcaatgatcgtcctattccgacctccggggctgggtgacaattgctggaacgtaagccgacgtcgatttgagctaacgcataannnnnnnnnngtgaaaggccagtatttaagacgtgggcttcggcttaaatctgttcccaccacgttccggcaattgacagaaatgcctggaagtcggcataggacacactaactaagcaagtttacgctaacctgaactttttccagcgggtctaagctggttgcttttgaacttaaaaacttggcacgttttaatcatgaaaagcaacaaacacagtgcggattatcggatagatgagaatggcagtgatggactcaaggaaaatagtgctgaactaaaaacgtcgtgactgacttcagtcgcgacgtttttgattagaaatttagtttagttggtacttgattgggcgtcgattgggatgtgcttgaatagttgggctgctttgacggcggcttgccagccttggtaaaggttcgcacgttggggcgcggccattcggggttggaagacattgccggtttggtggattgatttgagttcgtccaaatcttgccagtatcccacggctaggccggctaagaatgcagcaccgagtgcggtcgtttcgaggtcagcggcccggatgatcttgacgtttgagatgtcggcttgaaattgcatcagccagttgttgcgggctgccccgccgtcgaccatgagtgtgggcatggtgatgttggcatcgtttttcatcgtatcaatgacgtcgcgggactggtaggccagtgactgtagcgtggctttaacaaaatcagcccgggtggtcccgcgggttaagccaaagacggctccacgggtctcggaatcccagtaaggtgcgcccaatccggtaaaggcgggaactacgtaaacttcgttgtgattatgggactgttgagcaagactttcggattctggtgctgattcgatcagttgcatgccatcgcgtaaccattgcagggccgaacccgctacgaagatggagccttcaagcgcgtaattgatgttgccatcaagcccgtaagcgatggtcgttaaaaggttgtggtcggataattgcggttgctcgcccagattcatgacggtaaaggcaccggttccataagtatttttgaccatgccaggttcaaaggccatctgaccaaatagtgcggcttgttggtcgccggccatcccgctgattggaatttggctaccataaagcaagtagtccttagtcgtgccatagatctcagagttggaccgtacttctgggagcatcgcagcaggaatgttcagtaggttcagaatcgtttggtcccattgtaagtcgtgaatgttgaataacatggtgcgactggcgttggtgtagtcggtgacgtgggtctcgccaccagtcaatttccagacgagccaagtatcaatagtcccgaaaagaagttcgccgcgttccgcgcgcttttgggcaccatcaacgtggtctaagatccagcgaattttcgttgctgagaagtaggcgtcggtcactaggccggtgtgccggtgaatcagatcgcccatacaatcagcgatgagttgctcagctaacggtgcagtttgccgggactgccaaacaatggcgttataaatgggtagaccggtttgcttgtcccagacaacggtagtctcacgttgattggtgatcccgatggcttcgatttgattaggtttaatattagcgtcaattaagacgttagcgatcgttgaggaaactgcgttccagatttcagtagcgtcgtgttcgacccaccccggttgcggaaagtattgtggaaactccttttgggcgtcggcaactttttgaccggcgtgattaaaaataatggtgcgggtactcgtggtcccctcgtcaatggccatgatatatttggctgacataacttgttcctccgaagattgtaatcaataacatcatctttgatgctagcatggatgagtggatttgtgaataaatatcaaaaacttaatatataaactggcgtcccacgaagtatctagaattaatcatcacacccataccaatccgctggaatgaagaaagggttaccatgcttgttttgataatattacttttgtacaacggttagtaacggtgttgaactaagattaatgaatatttgaaatgtagaccaatcggcatataatggggactcaaatcggtgtgaaatggaggattcctagtatgcaaaaacgacgcttttttcttaaaggctctgctgccgaggttgcttggctcaatcggcaggcggcgcggggctatcaattgacggcgattcacggtctgagttatcagtttaaagaagtctcacaagcacgtcagttgattgccgaatacatgccacagacgacgttacaagctatgacgacggtcttccaaccacttactagttatacgtttcatgatgatatgacggtggtttattcaactgtggcccctaaacaacgagtggtcaacaatgatcaacaataccgcttagcagtgtatcgacatgctcgcgatgtcgccttgaactggctcaatggctgggtgttggtagtctggctcatgatgagtgcgacgattgtgattagctcgcaattacaagcaacgccactattaacccggttgttattacttgggttggcacttggtgctggggtgatggtggcaggtattatcgttggtgttcggacagcgattcgttgtcaccgggaagtgtgtcgcttgatccgtatcacaggagacgatcacgagacgcggaagccgacttttcacgtgttgtttaagcatcaacaggccgctcccgatacgacttgctgggatgatttaggcaactggcaactggcactgcataatcagcgtggggattactactatgagttaaaaacaacattgagtgaattagaaatcactaatacactggcacaacgcttttcaaaacaggacttttccgtggtatcgtggttaggtttgtacgttgtttgaggcggatatcatattaattatgtgaatttagtgtgactttttttaaaaaggacttgttttttatcataaaagcgtgtataaatacagacataatcattgcccggtagttcagcggtagaataattgactgttaatcaagaggtcgctggttcgatcccagcccgggcagttggtcatgtttagttaagtagcggtatctcgtgaggtaccgcttttgtcggcacaagtacagaatagcgctggcatttgatgggtaattggctggcagaactttagaaataattaactaaaaaagttctgacaaaccttgactattcttgactaaaaccgtatacttactatattaaagtaagtggtgtaaagtcacttgctgaaacttaggaggaattcatcgtgacagtaaacttatattattcaacgtccagcaagtctagtcgtagtgcacgagcatggttagttgagaataacattccatttaatgaacgcgacattattgctaatcctctggatcgcgatgaattgaaacaaatcctccggctcactgaaaatggcttcgaggacatcgtttcaacgcgttctaaggctttcaaagcattacacattgatttgtcggacttaggcttcaatcagttattggacctattagttgaaaaaccacaattactcaagcggccaatcatttatgatggtcggcggttacaaatcggttataacgaagaggacattcgggcatttttgccacgttcggtacgtaagtctgaattacgtgaaattcaacaaaaactttatgacgatgatcaacaagcagttggttaatcggatttagcgtttgagacgaaagcggcccatcaagaattgtgttgatattcttgatggggcgtttttttgtcgaaagaacaataccagccagccaccagggcgcgttaggttgcgtgtcttcttaacagcgtatcgcgttgtagggcgttattttacttgccgattaccgcccgttacctttgctgagtaagcagattccttggtataatcagttggtttgtgtacaatgtaaaaaggcttaaaggaaacggagattttaacataatgagtgaacaagaccaggctgcctgggcgatccaggcactcgccgctttgaagacggctgataatcaagttgttgtggagagtatcattaaggtcatcgatgaccaacaggctgagattgagagtctacggggttcaatggaaggccaattatggagtccaactagctggcatcaagatcagcaagcgcaacgtgccgcgcatgaggacaagtccacaactaaccattaaaattgagaagacgccacaaaagacggttgttagactattattggtctaacaaccgtctttttgtcactgcgtttgtgaatttaagttgagcgccatgctgtgatttacggcgcagtcgagcattaagctgccagcaagggggtgcaagcttcaggatacagttgtgatcagtaatccgtgacgcttgtcttgcggtgctgggccacaaattggaaggtagctgccacgagtccgccaatcaggatacccgttgcgttggcaatgacgtcgttgatatcgctactgcgattgatcagccaatgttgtgacatgaaatattgcagactttcaatgctggcacccactaacaagcccgttaatccgaggcccaatagtgggtagtgatgaaagtggcgtttaattccccagcctaagggaatcgtcagaatgatattttcgataaagcccagcccgtgaagatacaaccgtgataggttcacttggccgacaccagctggcatcacgtagatggcagttccgtcgaatgacagcggggtaaacaaaatcacactaaggccaaataagtaacctaagccgagtagctgccgcgtccgggcttgtggctggcgaacgtgggcaagaatcaccaaacaacttagtgttgcaactattaaaataattctgaacggttcccaacgcatgcacaccactcctcggtttggattaactgtatcttaccgtaaactcagtggtcagaagtaaagaagacgtgaagcttaatgaagcctttaacggcttaaccaaatcccaagtaaatcagtggttagatgaccgtgattgatgttggtcgtcagccatattcgcaattggtttcgtagtcagcgctaaagcagctacaatcataatgataattagactgaaccagagtgcgatctgggtgccgagggtggtttgcatcgtactcgaagcactcggtgccatgcgggtgcccaatgtaatcaagacggccataatggcggtaccgagcgaaccagaatactgttgtagggtgttgaaaagcgcgttgccatcgcccattagttggggcggcaattgttgtaaaccatacgtcagggcattgttaaataagcaactgaacccaatttgaaagccaacaaataagccaatgatcaagccgaccgagagatgctgggctaaccctgcgagacttagtgttgccaacagtaaaaagccactaccaatttggaatggtcgccgaatgccgcgacggtccatcaatttaccagccaaaggtgatagtattgctgaacataagcttcctgctaataacattaagcccgacactaacgcatttttacccaaagcgagttgtgcaaaattagggagcagaaaggtcagtccaatctgaatgaattgaatgaagaagtaaatgagaagcgctcgggtaaagttaccctgttggaagacggccaggttgattagtgggtgcgtggttcgggttgccgaacgggtaaaagtcagtacggcgagtaccgctaataacagtggtaaccagacgaatactaagcttaagccatgtgtactaaggttattgacgctaaaaatcagcaggatgagtgccgcgacgactagcccgaattggcataaggggaacggacgtgaccgtggtgcctgcgtttggcgaatagttttggccgttatcagccaagcaatcagaccaaacggtagggtaatgccgaaaattaagcgccaggataatagttgtgtcactaagccgccatatgttggtccgagtgaaggggccaatgcgatcaacattccagcggtccccgtaaaacgaccctgagcagtgaaaggaacctgggtcatgatttgcgcaaatactaatggtaatgccaatccagttccgatggcttgaatgattcgaccgaatagtagtaaccagagctgtggcgcgactgtacataataaaccgccaagaacgaaaccagccccgccaacgttaataattgtccgccaacggaagcgttgttgaataaacgccgtaataaccatggtagcggctacggcgagtaaataggcagtggtgacccattgaaccgttgctagagtggtgtggaattggtgcatcaaggtcggaaaggtaacgttcattgatgtttcaactaaaataccgcaaaaagccagactggcggtgccaaaaattgcaaccttcgtttgggttgggatgacaggtgttgttgtagataaaataaaacctccattgatcaaggccagctcgtttcgtatgtgaaacgacgcttttcttgaccaacggagattccgttgtaaagatatacaagcatcaaagacgaccttgatgaatttattaatgatttaatcctagcataatactgataaaaatgtcagtccgctttttttattcgctgactttagcgctttgttcagctaaagcagtcaggtgctcgaataggatgccttcacgcagtccattttgagagaaaatcatccggtcagaatctaaaaagcgcatcagactaatggcaggaatcatcccaccaacaataatatcagcccggtcctttgctaatccaggaatagccgcgcgaccagctgcatcctggctaatgacagtattgaatgtgtcatagatggcgttgtcacgtagccgataaccgtgaatatcttcaaagttgaggatattgcatttgcgccggttaattttggctaacgttcggttgctaccacccaaacagacgagtggtaagttgagaccgtttcgcaaccaccagacgctattaaaaattttatcaacgaaagtcatcgttttaaataattgactagcggtaacttggtcgttgaggccgaacttttcggataaactgaccgcgccgattggcagactgattaggtccttggcttggccgtttacgataaggacgagttcgcagctaccgccaccagtatcgaccatgacgcagttagtcgttggaagcgtattgactacccctaagtaatcgtaataggcctcggttgttccaggaatcacttcgatatctaggccaacatcatttttaacgcgtttgagaaatttcttttggttgctggcctttcgcgttgcggcggtcgccacggccttgatagttaagttaggtaagtctttgtagacggcagcaaacgactttagcgctgcaatcgtgcggtcaatggcctcggcttgaagggtcggcgtatccgtggcgttttcattctcggataaacgcaccatttccttgagtcggtgagtgactgcataactaccgtcttcctgaatctgtgtaattgtcattcgacatgaattggaacctaagtcaatgaccgcaaagttttccatcgctaatcatcctctctatcaagatctgaagcatccggctcattcttgggactcatcatcggaatgaactggtgcgcgttgctagtgggcgtagtatcgccgtgatcagccttgactgcttgctcggcttcgcgaatgaattcggcctgggagtccaaaacctctaagccgcgcccatccacacgggcgtacgtattatctggttgcaaaatgcgcgttttgaccgtgtcagcccacatcgtttcaaaaattgtcatcgcacggtgactgatttcaggttggagcagtgggaacaataattcgacccggcgatttaggttacgggtcatcatatccgcactggataagtaaatttgtggttcaccgtcgttgctaaagtagtatatacgactgtgctccagaaggcgaccaatgatcgagtggacctcgatgttatccgagatgcctttgatgcctgttcgtaaacaacaaattccccgaatgatcagttggatcttaacaccggcgtgagaagcttcgtagagtttgctaataatctgcggatcggataatgagttcatcttcattttgacaactgcgggctgaccagctttggcaatggcaatctcatcgtctagcttttcgttgataaagtcgcggatgccatctggtgagatgtgcaatttgtggaaatacggtggttcagaatagccagataacatgttaaagatgttggaagcatcgattcccatgtctgtatcagcggtgaagagccccatgtccgtgtagaaatgggcggtgacatcgttataattcccagttcccatgtgcatgtagcgcttgataccttcattttctcgccgaacaacgagggcaagcttacagtgtgtcttaagcccgatcaggccgtagatcacgtgacaacccatttcttcaagttttttcgcccagtgaacgttattttcttcatcaaaacgggccttaacttcaacgagaacggttacttgtttgccgttttgggcagcctgcccgagatacttgataatcggtgaatcagctgatacgcgatacagcgtcatcttaatggctaacacgtcctcatcttccgcagcttcatggataaagtccacaacgggtttgaaatcatcgtacggatattgcattaaaatgtcgtgatccttgataagatcaaagatggatcgttcgcggtacttcgcgggatagtaggcgtggtattttggataattcaagtcttcgtggccctgcacagcttttaccagcttggataagaaggtcaagttgaggggaccgttgatgacgtataacgcactttcgttaatcccaagggctttagcgagtcgcgtgcgttgatgcttgctcatactcttttcgacttctaagcgcatgaccttaccgcgttcacgcatctttaattgtttttgaacttcctttaataagtccgaggtatcctcttcggcgacatctaagtccaaatcccgcatgacgcggtaacagctcgtttccttgaccgtatagttgataaatagtgagccgacaaaggctttgataatttcctcaatcagaataaactggttcggtgcgcctggcaaaacgaccacgcgaggaaagacgtccggcacttgaacggtggcaaacttgcggtctttcttatccccatttttataaatccgtaaggcgatgttgagtgtattattcccaatgaacgggaatgggcgtgaagagtcgtctgccatcggtgttaaagccgggtacagctcatcgtcaaagtagttcttaacaaaggcgtgttgttcctcgtttagatcagccatcgacaagagatgaatcgcgtgctgttccagcaatggcaaaagcgagcggtttaatgtattgtattgacgcttgaccatctcgtgggctttatcactgattgcactgacttgatcagcagcggtcagtcccgcgggatccggtttagtgtaattgactgacatcaatttacgtaatgatgcgacccggaccgtgaagaattcgtcaagattactctgtgtgatcccgagaaaacggacacgttctagcaaggggttatccttatcacgtgcttcatcaaggacacgatagttaaaatcaagccagctgagttcgcggtttgtataataactttctttataataattcatttaacgtaccccccgtagtttaatcactggtgttaaaccaaagacttctttaaagaattccgctttttgtgcgaatacccaattttctaagaagaggtcatcatgagcaaagcaagtaatgatgacccgtggattgcgaattgaaacggaaattttatcaattttttgtttgcgaccgtcatccaaagcgtccgcaattctcaagatggcggatagtttggagactaataagcgttgttcgacttgtaagtgtccaaaatggcgaatgtcttttgatggtgtttgcgcgctatggtagcgtgaaatcagggcgaccattcgtttttcggtatcggttaatcccatgagttcagtggcctgcaagatatagtccgaatgtaagtaatgttggtgcgggtcaatgtagctcccaacgtcgtgcacgatggcggcgacttgtaagagtaagcgctcgcgtttgcctaagtggtgtagcggtttaagctggtcgaacaggtgcagtgagaatttggtgaccaagtcgcgatgcttaggttcaacgttgtacctgtccgcaatgttcttagctgctgttacgatttgatcattaaagttatatttcttatagcccaacttaatggcttcttgaataattaacccatccagcacggtcacgttgccaagccagattttctcagcattagtgagttgtagtaactcgttaataagtagtaattcgggcacgattaggcgcacgtcttcttcatcaacttcgtatttatccattaaatactggtcagaagcgttcaacacgtcctcatataaagcttgaaaatctgctttgctgagttcctccacgccagcttttgattgttgttggcgaaagagggtggcaaacggcgcgacgccgagcatgacgacgttactaggctgatctcttcgcccaggcaagaagcgaccaaagtcaacgatttgactcgaaatataatcatccaaaacttcaacatagttaggcacgctcgattgcaaatcttcaagaacttccgcgattcgaactggtcctaaacggaggctacgggagaagacaaagttactctgatcgtagtgcgaaataccgacactaccagagttgattcctaataagtaggtcggcttcgtgatcatttgcttgaatcgtggaaagtgtaccgcaactgcgactgaacgcaggtaggtttcctgactactagataaccagtcgatcttgagcccagtccggacaagtaattggtcttgaatatagtcggcattgttagcggatgacaaggaccacgacccccataaatggtagtccttaacgccgtaatcattcatgatctgaacaaaaccactcagtgcctgcgcggcttgttccactgaatcataatcgatcgtatgctgatcataaatatcctcaccaagtgaaacgtcggaacgaactcgttctacttggcgtaatgtgcgtaaattgacaatcgacaattcaatactctgaacgttaatcatcataattccaaataattttgttgccatggcgatcccccatttttatgatttcctgacccccaataaggttaaagtcatgtatttaatttaagtttaacacaggttggggttagttaaattagtattttagtagtgaaacagttagcgattacttttagtttttatacgaaagttaagcgtaattaaggccatcattaactttgtatgaatcttactagttaggtggttgatgtggtgcttaccccggtttcagcggtagcgaacgctaacctaacttggcacgtttgatccaagataccaaaaaggcgtggttcagccgtaacgagtatgcctgaaccacgctagttgatattataagatttcgtgattatcgataattagtttgttcagatgtttttcaactcgtttatcagctggtggcagctgcatgtaatcaccatacatccgggtcaaaatggtgtcatacgcactgggaatcttaacttggatatcttcgaatggaacggtcgttagctcggtcaattcctgataggtcataatttccttttcgtaatcgtattgagacgccagatttttgtaagttcgggagtctgactgctcgtataggcgcatgtattcctcacgttccagcttatagcgattgacttcagctaattgctgaggtgtgtgtttcgtaatcaagttgcgcagtggtgttttgacaaagcggtaattcaatttgagcaggatcgcagcgtctgctaatttgtaatgtaacatctgtgaacgacgtaaggcttcgtcatctggaatcttatcaaacggaaagatgtcaacgaacacgcctttaaacgcattattgacgttgttgcgttcttcaatgtaagtatttacgtctaatagcttcatataactgagtgcatagtccggatctgaggcaccggtttgtaggaaaaacttgtttggatcaagatagtggttggcgacggcgataaagcgctggtagtcatgacggcgcattccaatgtcgatgtcatcgtcccacggaataaatccgtgatgacgaatagcaccgagtaaagaaccaccgatcaaaaagtaatcgatattttcagcctcacagattgcgatgacggtacgcatcaagcgcaattcaacttggtgtaagggtgtcaggggcatggtctcgtctcctttttacgtaagcgtttcaactactttcatcatacactttgttgcacaaaattgttagggaggatgcttaacgttggaatttacgggtaatttcatgcaaaacagttaaaggcgtgttatatttggtcaaaagttaatgaagtgatggtggtcgcgatgaacagtgacgaattaagcaaacttctcaatgattattttgaagcatatcaaaatacaaccaaaattatgatggacttagtggcttggcctttaagtcaaaataaactgtcatttgaacaatttttaatattgcggcgcattgccacgactgatgaagtgacactcaatgatattgcaattcagcgacaagtaacgcgaagcgcgatttcacggcaagtcaaatcattgttaatgcaacactatgtttttcaggtgccagatccgcgtgatcggcggcggctctacttacatttaacagaacggggacaacaagtcgaacggattgtcgaccaagccattacccagcactttgatcactgggtcaaccagttgggcgcaccacagattgatcaagtgctcaagatgatggggacctttagccagcaggtcacggacctcggtgagccacagtcacaccccgttctacactaggatgtacatgggactaactactaaattagtattgatgagcaactattttggtcgctagtcaaaaacagacttcttaggaattgtcacaattcttaagaagtctgttttgttacgaatacccattgaataaaaacacttgtactaaagtagggtcgtttcatagaaagtaagcactcaaatgggcgtacttgcttcactgtgatacgtgtagcgctcaatgcttgaagaagttatggtaaaccccttcgcaagcttcaagaaacatcccaatagccattaagtacatggctaacatgttctgcattgtgaagaccaagtagagtaggacagcgtagaggattaaaaagaagattgccgtaattttggaaccagccatttaaatcacacctttgtatggagaatcgtgacgcgttatttgcctgagggtcgtgaggaccaagagcggttttaaggcaatgaacacgctttatcaatttcattctaccgcaggctcattaaaattgaaaatcgcaattaaacagattcaaaattatttagcgttcggttattgcttttaaataaacaaaatgatacgattaaatacgttaaaagaacgctaaaacacgaacgtttacaattgtgcaattataatttagacgaatatttggagggaatcatgaataaaattgcggcatattttaatttttcagaattgaaaacgtcaatgcgaaccgaagtgctggctggcttgaccacgtttgtttcgatggcatacatcctatttgttaatccgagcgtcctcggggcttcggggatggataagggcgccgtcttcaccgcgacggccttagcgtcagcgttaggctgtttattgatggggttagttgctaagtacccgatagcaattgcaccaggattaggcgttaacgcgttctttacttattccgtagttatcggaatgggcattaaatggcaaactgctctggctggggtgttcgttgcagccgtgatttttatcttgattacgatttttaagctccgggaaatgattattgatgcgattccgcgggatatgaagttagcaatttcggcggggatcgggttcttcattgcttttattggtcttcatggtggtggcttaattgttgccaacaaatcaacggttgttggtctgggatcattgacagttggaacgacctggttaactatttttggattgatcgtcacgttgattttgatgagtcgcaaagttcccggtgggatttttatcgggatggttttaacctctattttagggctagcaactggcttgattaagatgccatccacaattgtttcggcagcaccttcgttgaaaccaacgtttggtgtggcgcttggtcatattggtgatattaattcgttacaattgattattgttgttttgacgttcttattagtgacattcttcgatacggccggaacgctagttggattggcagaacaggctggattcatgaaaaataataaaatgccgcgggttggtaaagcgttgatggccgattcaacttcgatgttagttgggtcagtgttgggaacctcaccaacctcagcttatgttgaatcttcggccggaattgcggtcggtggtcgctctgggatgagtgcggttgttactggtgcgctattcattcttggattatttttctcaccgttattaaacgtcgtgacggatcaagttactgcacctgcactgattattgtgggtgtgttgatggcagaatctttaaaacagatcagttgggaacggtttgaaattgccgtacccgcatttctaactgttatcgggatgccgttgacttatagtatttctgatgggattgccttaggcttcattgcatacgtcattacgatggtcgcaactaagcatgccaaggaagttcatccattaatgtacgtgctgttcttcatcttcattatcttcttgtggatattaaatgtctgacagttaaaggtggtcagctcgacgttattggctagttacagataatttaaatgacttaattctaaacggactactgacgcacatgacgttggtagtcttttttgacgtgaaataggctaaaacttgatgagcgtcaagttggtttgctctggaggtgactatactagagtcattcaagtgatagaagggggaggcgaaataatcagaaagttaggataaacattgaaatgtaagcgtcatcatcaagatctatttcgaaactagctcgtgagcagtcaattggccgagatttgctaagcggggcaagcgtgacgagtggggatgtacccgtaccaattcgatttaataagacaaatacacaattagtacggtggttaaggtggtataccggtgtcgaaaataatacaaaatataaaaatacaaaaaaatacgttttttttaaaaaaattaaaaacgctccaaagcccgtcgttaacgcttgtaaaccatagaaagtttcgcaaaatttctaatgatagataaaatctattgataaaagcgtttacattttaaaaaatcgtgattacaataaagtcgtaaagttgataattaaaatatatcagaggaggacattactaatggctaaaattagtggttcagatgccgtattaaaagtaattcagaagtggggcgtaaaacatatttatggtttgcccggtgggtcgttcgattcaacgatgaacgccatctataatcaacgggaaacgttgaagtacatccaagtacgtcacgaagaagctggtgcgattgccgcttccgctgattataagctaactggaaagatcggcgtctgctttggttccgctggccctggtgctgtccacttactgaacggattgtacgatgctaaggaagatggtattccaatgttagcaatcgttgcacaagttcctactaagcggatgaacatggacttcttccaagcaatgaatgaagaaccgatttttgacgatgtggctgtttggaatcggactgcgatgactgctgagagtttaccgatgatgactgatgaagccattcgtcaagcgtatgcccacaatggtgtagctgtcttaacgatccctaaggactttggttgggctgaaattgaagacaactttgaaacgaacgctagcgtgcacactgttaactatcctgcaccaaccgctgaatcagttgctgatgcggttaaattaatcaaagctgctaagtcaccaatgatttactttggcgttggcgctaaggacgcggctgaagaattaaaagctgcttctgaaaagtttaagatgccacttgtctcttcagtattagcgaaggggatcattgaagacgattatcccgcttacttaggttccacgggacgagtcgcacctaagccgggtgccgagattggctttagtacggatctaatcctctgggtcggtaacaatgtcccatttagtatcttcttatttaataagaaggctaaggtcattcaaatcgatattgatagtgaaaaatttggtaagcgccaccatacaaacgttgctattcaggcggatgcgaagaaagccttagcggcgattaatgcagctggtgaagcgcgcgatgattcagccttttatgacgctgcggttgctgataaaaagaactgggacaaatggcaagccagcttcaacgatagcactgaatcaccagttcgccccgaaccaatctttgatgtcttgaaccaagaagctagtgacaaagctgtttgggccatcgatgtcggcaatgttaatattaactttgaacgcttgatccggatgcacgataaccagaaatgggcaacttctgggatttatgcaacaatgggctttggggttcctgccgcgctggctgctaaagtcaactacccagatcgggacgtctacagtttgagtggtgacggcgctttcgcaatgctgtcagaagaaatcttggcacaagttaagtataacttgcacatcatcaacattgtcttcagtaatgagaccttaggctttattgaagctgaacagactgatgatagccatcaaccactctctggtgtcgatttgccagatactgattgggccaaggttggcgaaggctatggtgccgttggttataccgttcggaccaaggctgaattcaagcaagcccttgaagacgctaagaagacggataagccagttgtcattgatgtgaagttaacgcatgcaatgccatttacaacggaacatatgtatctcgatgacgcatggcaagataaagacaagattgctgaatttgtcaagaagtatgatgctcaagcgttgaagccgttcagctacttcttaaaacaagctcaaacaaactaatttggatagataattaacgaaagaggacgcgattatcgcggctcttttggtacatagtattaagtgtcgcttgccattgtggcggtgacaacataccaagctgtagagaacactacgtgaacgttcgggaggtcgcacagatgcaagtaatcaatttagatgcccatcgattaaagatgctggcaccacaaccgccactggtattagctttaggtttctttgatggtgtgcatcagggccaccaacgcgtgattcaaacagcgaaacgaattgcgaagcagcgtgatttaccactcgctgtgatgacgttcaatcgacacgcgtcacaactgtttaagtcccagaccacttttcggtatctgaataccgtcgcgcaaaaaagccaacatatggcggcgctacaggtggaccgactatatattacggattttaaccaccaatttgctggcttgacaccgactgcgtttattaaggattaccttgtcgggttgaatgcgcaagtcgttgtggcggggtttgactatacgttcgggcagggtggcgcaaatgggatgcgcgaactcgcggaattgggcgccccgtactttgaaacggtcacggtggatcgcttggctaatcagcagcttaaagtcagttctactcggatccgggggctgattgctcgggggcagattgaacaagctaatgatttattggggtacacttacgcgacacaggcgacattcgatccgttgactagaacgatccaacttgcaaatcggcaacagcagttaccagcggccggtgattatcgttgttggttagttagcgctaattatcgacaggcagtcattctgcgagtcaccacgacattaaaaattatttcgccataccagttgccaccggaaaccacggtattagatgtggacgttcagtggcagcagcgtgctttgcaagtggtcagttctgtctcagcccagcatcaacaatcacaatatagtaaagcttaatgtagaccaccctgatctgtttgatggggtggtttttgattgtcgtcacgtcggtaagttgttcgtgctagatcgttagcgatatttgataaaactgagtatcgggtgtgtgcttgatcctatttttctagtccatagatagtttcacatgaaataatcggataaacacaaaattggcgctgaatggtgccccgttttgtgtacttgtaatttcacttacgaaaagtaagcatattaattgcatttataattgaaagcgatttataatacgtttgttaaatgaattgaaccaagcagacaaattggttctaagtcgaagggatgaatagtgatgacaaagatgattgcaggacaagctttagttaaggttttagaggcgtggggtgtggaccacatctacgggattcccggcggttcaatcaatcataccgttgaaggtttgtaccttgaaaaggccgatattgattatattcaagtacggcatgaagaagtgggggccttagcagcctcggcagatgccaagtttacaggcaaaatcggtgtttcatttggttctgcgggtcctggtgcaacgcacttattcaacggtttgtatgatgccaagatggatcacgttcctgtattagcacttgtcggacaggtgccacaagcgacgatgaacacgaattacttccaagaaatggatgagactccaatgtttagtgacgtggcggtgtataaccgcactgtcacgacggccggacaattaccatatgtcattaaccaagcgattcgtgaagcataccggcaaaagggaccggcagtcgttatcattcctgaaaatctctcagcggaagaaatcgattatcagccggtatcgacgcctaacaccgtttcagatacgtttgaacaacgggtcgatcctcaggccattacggcaacgttaaagatgctaaaagcagctaagcatccattagtttacgctggtcggggtcttcttggtgctaaggcagacctggtcaagtttagtgaacaatttaatatcccagtcatgaacaccgtcccagcgacgggggttattccaacgaaccacccgaatgcaattggtacgtttggccggttgggttccaaatcggggttcgaagcactccaacacgctgatttgattttgttccttggatctgaatttccatttgctagtttttggcctaaggggattaagattattcaggtcaacaataacagttttgatatcggcaagatggtcccaatcgattacgccgtcatcagtgacgcccaagcttatttgcaagcgatgattgcaactggcgaaacgttacctgaaacagtgtggttaacgactaaccggcaaaataaacgtaattgggataagtggctccaacaattggctgctgacgaccatgatggactagcgccggaagcggtcatgcacaaagttgctagtatggtcggccctcgtgatacctacggggtcgacaccggtaacgtctccgaatgggctgtccgggggctcccaatggatcaggagcaacgctttgccttatctggcctcttcgcaaccatgggatttggactacctgctgggatggctggtgccttaagtgttccagacagccaagcgtggagtttctcaggcgatggtggctttgcgatggtagcgccagatattatcacggaagcacgttacggcttgcctgttattaacgtgattttcagtaatcaacggtttggtttcatctatcgtgagcaagttgatacgaagcaacacttgtatggtgttgatctcacggatgccgactgggccaaagttgcagatggccttggtgggattggttttactgttcaaaataatcaagaggtcgaaaccgtctttgaccaaatcaaggcgctccaagcgaagggcaacaagcggccaatcgttgtgaacgcggtcatcaagaatgatgatccaattggcacagcttacatgccactagatcctgaattatatggtcaagcagaagttgacgcttatgccaaagccaaccacattgatattaaggaacagccatcattaggcgccttactacgagcacagggtgatcagctatagttaaagcctgaagggctagttagaccactgggcaaagattcagttaacctaatattattaaaaagccgccagtatcgggtatgacctgatactggcggcttattagttgttcagttaggatttatttttgattaaagctgccatcttccacgtcacgaatgaattgtttcaaatggtcaaagtagacgggggcgttgtcgatcatgtggtgatgaccaccatttggcgtcgttactaagcgtgagttaggaatatcacgagccatgcggcgggccgaagctaatggcattgtttcgtgttcaccgaaagttaacagggtcggcactttaatgttgtgaatctgatcgcgaatatcccattcctttaacttcccagtgataacgaattcattatcaccttgaaaggcgttgtatacaggagtggcagtggtgttgatcaaatggcgaattgaagtgggttgtttgcggtcaacatagccagcgttcagaacgtccacgtacttctgatactggggatcattccagttgccttccgcttccttttgcttcatataagcaacagcgtcagccggtagggcttcttcacgacacttgttaacgttgacaacgtattcctcaatgttatcgaccatacttgaaataatggcgccttttaagtgttgaccatacttgagcgcgtacatcattgtgagggcgccgccccaagactgaccaatcaagtagaagttatcgagtcctagtttttgtcggacttcttcaacttcatctaagaagtagtcgtaggtgagatatttcttagcaatttcaggatctgagtagtcgggttgatccgaataccaggatcctaattggtcgtacattgaaacttggacgcctaaatctgccagttcctcaccaaagttttcccagtattcgtgattgccaccagggccaccgtgtagacataataattgaatgtcgcctttgccctgagtattcgtccataaatggtagccattatccagcgtgatgattgtcgttccttgtttcaaatgatcacctaatttcttcatattttaattgttatcttaccactgttaactaagcagggtcaaagagactaggcaatcataaagaattgcattaagtagataattggtaaggtcgtgttcgctaattaactgaatcagtacgttaacgtcatagtagctgagtatgggaggggacttcggtcgaaacgatataaaaataataattagaacgggccgtttagtctgaatttggtttatactagttattatgctggtcggtacgactgatagaccaagtttcagtcgtattgtgaccgattgtacacaattgatttgacaagcggttacattttcagcgataataagtaaactgctcagcacagaaagatgtaatattacattctttaaattcaattgcggttagttaaccaatatgaaataatgggttaactaattagagatgggtgagattgatatggcaaatcaagtcgcagttttacgcttgttaatccaagcggcgcccgcgtactgttcgggtgactggttggcacaacgacttgcaatcagtcgaacggctatttggaaattagtgcaaggattgcaagcggcgggccatactattgagagccggcatgggcgaggttatcggtatgtggccaataataaattgagtgcgccggtgattgaatacgcgcttacagcgttaccaccgtttgatttgaccgtgctaccaacggttgattcaacgaatgcctatttacggcggttagtcacgcagacgcctttagcacttccgaaaatcgtggttgcggatacgcaaactgctggttacggtcggtcggggcgggcattttattcgccagcacagactggaatttacatgagcattgggttaccactcagtgaccagaaggcgttagacgctggtttgttgacaacgagtactgcggtagtcgttgcccagacgctgcaacagctgtttgcggttgacgtttcattaaagtgggtcaatgatgtgttagtcaatcatcacaaggtggttggtatcttatcagaaggcatcactagtcttgaaacggggcaaatttcagcagtcattattggaattggcattaacttaacaacgacagcttttccagcgctactagcgcacaaagcgggcgcagtcgttgccaatccaaatggtgtgacgcgcaatcaagtgatttgtgagctactgcggcgctttttcaatagctatgggacttatcgtagtgggactttcatggacgcttatcggaaactctccatggtgatcgatcaacaggtcgagttgaagagcggaacgcaaaagtatcgtggagtcgtcacggatattgatgcacacggggcgttagtcgtcaaattagagactggtcagagtcgtcattttagttctggtgagattactaaggtgaacctcttgtccggtggttatcatggctagcaagtttgtaaaatcaatttatcaagttaccgaacgaatcgcgtcaatcttttaaaatgatttctgattcaatgttttactggttcatactgttgtatagtagaagttagtcacaagtagtgctaatcaatttcaatttgattaattgagctgtttggtacgtcgaatcaaccttaaattgttgataacataggaatgataacggatggattaatagactcacgtttgatttatttatattgtaattaagttcggggttatatgtgtttaatcagcataatgaataaagtggttaataaaaataattaatgaagtttaaataatgctggtcaatgcggtcatttacatattatagtaaaggtaccgaagcactggtgggttagttaatatttgtagagacaattcaaggggtaataggaatatgaatgaaaatttgcggagcgtaaatatgagccgaacaatgagtcggatgaatcgacaccggatgaatccaagacgttatatcaccggatttgatggtatccggacattggcggtgctgggtgtcatcatctatcacttgatgccggcctcactacaaggaggttacttgggagttccgatcttcttcgtcgtttcaggttatttgattacggatattttattacaagatattttgagtcgggggcatgtccggatatggcggtttctcggacaccggatgcggcggctatatccagcattcgtgacgatgttgttagggacaacagcctacattacgctgtttcaacggtcattattgacgaacattcgggctaccgtattaacgaatttagtctacgtctataattggtttgaaatcaatcacggtcaaagttattttgaccgtttcaatggtgaatcaccgttcactcatttgtggtcgctctcaattgaaggacaatattacttattctggccattagtgattggtatcttgatggtcatcttcaagaagcgttcacgggtcttctggtttatgatgattgctgcgggtatttcagcgataaccatggcaatgttgtatgatccagcgaatacgaatcgggtgtactacggaactgatacgcggatgtttgcaatcttgttaggttctggccttgcgtttatctggccatcacgggaattatcggcggacattgctaatgttaatcgagtgacactggatatcttaggcggtgcttcgctaattgcaattatttggatgtttttccagatgtccggtcaatctgatttcacttatcgtggcggtatgttactattcacagtcctatcaacagtgttagttgcaacggtggcccacccggctagtcatctcaatcgcgtcttgacgaatccgttgtttaagtacgttgggcaacgtagttatgggatctatctctaccagttcccagtgatgattttctacgaaactaaagttaaaaacattggtgatcatttactcctcaatagtttgattgaagttgccttaattttgatcgtgacggaattgagttatcggtttattgaaaatccaatgcggcactatgattacagtcggttattggtcgacttcaaagatttcctccgcaaaccgaagtttaaccgcgtgaccactgcgattgtcgctttgaccacggtcttattcgttattacggcggttggtttcgttcaacagccaagtaaagcggaagctaacaagaagactgaattacaaaagacgattgcagctaactctaaagcggctgataagaagaatgcggcggcgctcaaacggcaaaaagctgcccaggcagcggctgcttcaagcaagaaggttgcgactgaaaagatgcagaccaagcaggctgaagcgaagttgaactcgaagcagaagcaggtggaaaaggaatacgatttgaagccacaagttgttctagcgatggccaatacggatctgacagccattggggattcggtgttactggatgtttcttctgatcttcaagatgttatcccgggtacggtggttcaaggtcgcgttggtcgtcaagtgacggaagttcctggaatcattaattcgctgaagtcgcaagggcaattagcccataacgtcctattgaacattgggactaacgggacaattacggatgatcaagctgaacaagtcgttaagctgattggtaaggatcgtcagattttctgggtaacggcccacgtcccaacacagagttggcaaaatcaggtcaatgctcaaattgccaagactgctaagaagcatgcgaacgtgcatgttatcgattggcatggtcgtgcgcagaatcaaagtggttggtttgcagatgacaatgttcatccaagtacgactggtaatcgccagttaacgaatttgattgcgaaccgcattgccgaagttaataacaattaaagatgagttccagcttacgttgatggtaagctggaactttttttggctagttccggacgggtgggggtgtccgacctggtcatgataagtggctatttaagttgaaggtacacaaaaggcccaccagttaacggttgtgtggttagctggtaggccataattagttagtccgttatttttttcattgggacgtgtaagcgaatatcgttcaagttaagtgagtactgtaggtcttgattgccgcgaatcgtcatcttcatatcagttgcgtaaatgactagtccgagttgatgccccttcagtaagtggtggaacagcggttggagatccacagaaaagtcataaaagacatttggctgaatcgcttctgcgtgccatgggtggtgacggttctgcaagttaagatgccccttagtaatcatcttgaacggcgtctcacccgctaacttgaagtccttcaaatcatcttcgcgccagtggtaacctagatcaagcgcttttgcagccagcatttgtgggctgacagtcaaacggcgcgcggccccgaagtcaatcagcataaagctcaacatgccgaaattcttattaacggcgacagagcccgcaacgtgcggaatacccactaataattgatcctcaggcgactgccaagacttgaacaagaggcggtgatcatagagcggatttaacttatcctcttgcaagaggtcgcgctgccaactatccaaatgatgcttatagtggtcgaataatttgtcaggcaatttatcagtaaaatgagcggcgcgttggtcaactgtatggtcagcaggaactaattctttgtactgaaccttaaaatctaaagcgtcggttgtgtcttgccaccaattgtcatagccgtgccaagtttgggcttgcgtgttgtcttgtaccaagacgttaggcaagagtgtctccgcatgattatctaaaccatataatttatggcttagccacaagttcatcatgtcggtgaaatcgagcgattgtaagttattgatataaatatgttgtccctggtgcaaaatgagctttttagtaacgggaactgcctgtgatttatcccataaattagctacgttgcggggcttaacgttccagtcattgagcccgtgaaccatgatgatgtccgccttaattttgtcaacgttcttgagataattgcgttcatcccagaaacggttatagttaccgcttgctcggtcttggtcggcagtcagttctgccagtttctgatcaaacgcgggttggatttggtgagcgtcaccggcttttaagcttcgtgagaagacctcagcggcgagaacatcggtgtcttcgccttggaacgtatcgggagcgacgaccaggccattatctcgataatagtcgtaccagcttgagatggcggcctcggaaataatcgtcttaaggccagccacgcccgtcgtagcagcggcagttgcgagggtaccgaggtaagaccggccagtcatagcaacggcgccgttgcaccaccaagctttgatagcgatattgccatcacgattggtgaaggcttggcgtttgccagtcaaccattcaataattgcaactgttgaggtcgtttcatcaacgtcaccggtaggggctagcccatccgagtcgattgaaccaattccagctgcatagacgacagcaaaaccgcgcgctagaaagtaatcattgagcgtgtaggacttttctcggctgaaagtctcctctgctgtatcggtcgtcgtggtcgcggttcgagcggctggtagttgcgccgttgttggctggaactcaacatccgcataggtattttcgtccggttcctttgcagtcaggggaacgtctacgttgtgcatttgagcatcaccagcttggtcgttgatgccctgattataaggactagcggtatagagaacgggaacttttaagccggtttcggtctcagttggccgaaggatttcaactttgagcaggtcccgttggccgtcgtggtcagtatctaaaggcgcttcaacgtagacgacgtcacgaatgagcgcgttggtatcaaagacggcttgggccttaccattgaagaagagtggcttttggtcgttaggtaattggtaaaatggtacaaagtaaccccgggtcgtgagtgattcaatcaaggtttgtccattattcccacgtgtatttaataataggtaccaagcataatagagggattcacgatcaaaggcgctatcaccgactattggcaagtgaatatcgcgcatcgccagcaatggatcggccaattcaaaatcttgaccaggtagaaaacccagtagctgaagtcccacgttataaaagacttgattgtttacgatagttgcatcggcgagccattctgataaagtgtgctggctggttgccatgatgttattaaacttgtgggtcaagccgcttgccgtgtgaacttctggtaagcttttagccagcaatgcctggtagacggctggaacagtcgtcagggcgtccatatcaggcgtaataaaatgaatttttgtaagttcggcaatcgcggtttccgaatcagtcgggacgattgcaaattgattatttttcataagtaaattccccattaagtattattagaaatattataccgctaattagtcgagaaccaatgcttcttactgacaagtttataatgttgtggtaggttaattgcaaagtgaactatcgaatggaggaactaagattgagtgattttccaattttatatacgacccaagcagttaatgaagacggcatcgaaggacacgcctatattcccaatggtcttgaggtggccgtatctagtccacttaaggcggtgccgggctcgaatccggaacaattaatcggattggcgctcagtacatgccttaacgcgacgctggaggcaatcgaaaaggagcacggccagacacatcagagcaaagtcgtgactacggtgaagatgtcgcgtgaccgttttgggtaccaatttttcctagatgctcgggtcacgattccggaagtggatgctgaaacggcagcacggtggctcgcgattgtggaaacgcgttgtcccgttgccaagctcgttgggccatcagccaacgtgacgattcaattggcttaaccgttgtgatatggccgcagtaatcattaatcgtagtttgtaaaaatgtcaggggattgattaaaacgtggttcgagttggcagcgattaaaactgccaattcgaaccacgttggtgttaatgatgactgcgaatttgcttgaaaagttggcgtaaacttgggtgctgacagtgatgactagtaactgctgactgaactttatcgacctgttgtagggcaagttgcttcgttttttcgcgttcgattttgagctgcttgcttagtgctcgcgatttccaaaagccgttgatgccgacgacaactggaataatgtgtaataaggttgtggcgggaatgagccagggatgcttactgaatagttgaacgacctgggtatgatgctcatgaaggtcgtcatggatcgttttgggtgttaacatgattaaaccacgctccttaattaagtatcattatcataccttaaaatgtaatcgttgtcatcgttagctggctgacaatagttaaagcgcccatctcaagttgattgatcacttgagatgggcgcttttagttagtacaaatctagattgttactcatcagctttattcatgcgactatgccgaatgccatagccaaagtaaatgatgagaccaaggaggaaccagactagggatgccagccaagtttccatggatagctgggtcatcatgaacaggcacagcaagccagaaataattgggagaaccgggtaaagtggcacgcggaagcccttgatcgcgttgagcttgggattacgccgtagtagcaaaattccaaaagaaacgaaggcgaaggcaattaatgtcccgatattaaccaagtttgccaattggtctaacggaatgagaccagcaagaattgaaatcacgattgtaaccgtcaacatggcgtttttaggggcgtggtgcttatcgattttacctaagaaacgtgggagtaagccgtcacggccgattgaatataatagccgtgagctactgtagatcatcgtaaccatcattgtgaacatgccggcgagggcaccaatcgagataataccggcaacgaagttttgatggacgagttgtaaagcgaacgccactgcatcgtcaacgttcaactgtttgtacgaaaccatcccggtcagcactcctgaaacgagaatgtagaagatggtacagatgactagggtcccaatgattccaattggcatgttgcgcttggcatttttaacttcggctgccgacgaagacacagcatcaaaccctaagtaagcgaagaagacgaccgcggcgcccttgagaattcccgtcccaccaaatggggcaaagggtgtccagttacttggtttaacataaaatgaaccgactaataagaacaatacaatgattgctaattttacgaccacaataatattgtttaatcgaatcgacgtttttaggccggtatcgataatccaagcaatcagacagacaatcagaattgcgaccacgttgatataggtcccgtgggcggggtcaaacgaaccggtgatggctttcggtaacttgaggccaaaaccagcaatgaatgaattaaagtacgcggcccacccaacggcaacggtcgcaacggctaggacgtattcgagtaccagagcccaaccaatgatccaaccaatcatttcgccatagacaatgtttccgtatgaatacgcggaaccggcgattgggagcaccgaagcaaactcggcgtaacacattgcggcgacggcacacacaatggcagccaaaacgaaagataaaataatcccgggtcccgcttttgttgcggcaaccgttccgggtaggatgaaaatcccggtcccaatgacggcaccaatcccaagtgcaatcagatcgactgcggagagggttcgttcaaaatgactatctttttgtaaatagcgctccaaatcttctttttggaaaatgcgctggaaaatccccataacatggaccacctttttggttatttgtaacagttagttgtcattatcgacaaatcgtcatgtcaatatgataccgtggttgattattaaaagtcaattagaatcagccttttattattaataactcaatgggatacggagcaagatagctggttaatcatcatagaagctggtgacattgcgactgtcgaggcaatgttcgtgctgacaatagatttgatgacgataacgcgtaaccagtcatggtggggatttaaaaagcgttgtgatggccgaattactagtcatcacttaagccggcggtaacggtgctaagctgaagagaaacgggtctgaatatgcggttgggtagctgttactattgttatttataagttgatactttgttataacgaacggtagtcaaagaatacacacggataatacattaaactgttaattggattcgccaaagcttataatattgttatcaatagaaatttaattttagaatggtgggattaggatgggagcggcgattgatattaccggtcagcacttcggacgcttaatagctgttcaccgagcgggccgggccaagaatggtaatgcgctctggttttgtcagtgtcagtgtggccggacgtgcgtggtggattcctacgttttgcggcacggcaagacgcgtagttgtggctgtctagccgtggaacagagtcggcaaaatatttttaataatccgcaagcagtttcgcatatgggggacccgcgtaatttgaagattcgtgatcaccatacagatgtaagttcaatcaagaagtcgaagcgtaacacgagtggggtcgtgggcgtgagctatgacaaacagtcaggttcctgggttgcgcacttctactacaaaggaacgtacatattaaacaaacattttgcgcattttgaagatgcggttcgggcccggcacgctatggaacagcaatatttaacgtcatctgataactgaaactgtcggatgcccacgttaggattcactagcaaattgtaggctagctaatattgtggataatatttgaaggaactgaagtcggttaagtgtcgaagggcttcgacgtaatgtgtgcttagtctgatgaggatggatgataaattttaatgagttgaacaacgggactggcaatccgctgctcaactttttgagtcggcactaatcaagcttaatgatgacaataccgttgcggtttgcagtgatgagtaatcaatgcccatttgagtggttgatttaacctttcttttgaagcgaagaggttacagtcagtcggagttctgatagaataagcattacacgagataagagggggtagcaagattgtcaacaatgttagtggcggaagatttatccgcagtcggtggaatctcacttagttcagcgttgcccgtattaacggcgatgcagtatgacgtggcagcactgccgaccagcttattatcgacacatactagcgggtacgggacaccagccgttgtcgacttatcgacgtggctgccgcaggtctttgcgcattggacccgtgcacaactgcattttgatcaagccctgatcggctacgttggttcggtcgcactgtgccaacaaataactacttacttagaacaacaaacgctgtcgctattagttgttgacccagtactcggcgatctcggtcaactctatcaaggctttgatcaggactatgttgcggcaatgtgtcagcttattcaacaggcggatgtgattttgccaaacacgacggaggccgcattgctaacgggagcgccctatcaagtgacgccagatttagaagttattttgccagcactgcaagcacagttgaaaactggtgcccacgcagtcattacggatgtccaacgtgctgatcagattggctgtgcctggttggatgaagctgggcacgtgcaatactgtggtgcgcgacgtttgccggggcattataatggtaccggtgatactttagctgctgtaatcgcgggactgttgggccggggttacgcgttagcaccaacgctggcgcgcgctaatcagtggttgaatatggcggtagcagaaacgattgcacaaaatcgaacggatgaccggcaaggggtcgcactgggggacttgctccaggcaattttagccctcaattgatgatggaacatgttatactagagcataattcataattaggaaggtgcgacttcatgagtacagaagtagctagtggtgcggtcgtctatcaacaaaaagatggtcatcccgcttatttattattacagagtgcgaccagtgatttttggggctttccgaaggggcacgttgaaggcaatgaaacgttagctgaggcggcgcgacgtgaaatccgtgaggaaactcaaattgaagcgacactcgataccaattttaaggcgtataccgaatatgacttaccgaatggtaatttgaagcaagtcacactgtttgtcagtgaagtcccaagtggtgtcgtagtgacgcggcagcaagctgaaatcagtgcaattggctggtttgattatgctgctgcccgtgaacgattgacttacgataatttaaagcaaatgttagatcaggctaacacctacattgagcagcatctacaataatactgactgtaaaaaaattactggtgccgtcgcataaacggtaccagtaatttttaaacaatatttttagattggcttaggcctgggtttgtaagtttgcaactgcatcttcgattgttacgccttcagcgaacaattctggatgaagtttgtcagttgcgacaaacatttggcgttgcgtatctaagacaatgctgaaccagctatttgttttttgaaattgcatatgacaaaactcccttctgaaaattgttggtttgctacgagatgcgtgaatcatctatttgaaccttataggtacgctactatactcggtttaccgagctaacgcaaatgaaaagctttacatgaattaaaaaatggaggtttatcaactttgacaacgaaacggatctttgtaatcacgggaccaacggggagtggtaagaccactgtcagtcattacttgcggtcacaataccaaattcctcaggtgattactcatacgacccgggctccccgggaaggtgaggtcagtgggcgcgactattattttgaaactccgacgagttttgccacgaaacattatttagaacacgtgacctatagtggtaatcaatacggttcttcacgagaaggactagcggcagcctgggaacggtcaccactgattagtatcgtcttagatacggcgggggctattacctatgcgcgggagttgggcgaacaagcggtggtgatttatctcgaggttgctgatcaagaggcgctaattcagcgtttgaccaagcgaggagatcttcctagccggataaaaaagcgagttgctagtgatgagtatttgcgggaccaggctttgccagtaggattagtggggcatgcacatgttatcgtgaatgatgattggcaggcgacgcggcgccaactagatgagctggtcactgaatattgtcagcatgatgttgtgacgaaagattagcgctgacgtatggacggtcaacgtaattcacttttacacttgagtatgctaaactaaatagtaatgattatgatttagtgaagtcctggtcagtaggaggcagcaacattatggaaacaccaattgaacaagccgtcgcaattttacgtcgcaatcagtttaaaattacgaagcaacggcaggcattattagattatctggtgacctatcaggaccactatgtggcaatttcggccgttgatgagcacatgcggaccttatttgcaggaatgagtcacaataccatttatcgcaatattaaagagtttgaaacgttaggattattggaattgaaggcccaggctaatcaaaccctggttaaatatcaatgtgatttcaagcatcaacaccatcaccattttgtttgttcaaactgtggtaaggtgacggaactgcaagcgtgtccgttagacgagtatgaagcacaattaccgggttgtacgattacgggtcaccgcatcgagatttacggtttatgtgccaattgcacgaaaaagcaggcaattaatagctgacggggagtcggcttttttgttggccttgtttgagtaaagagtttcttaatttgtgatagaattagtgcattccgaacacgagcatggtttaattatagattagaaagaataacggcaaagcctcagaagggaatgacatcgatggcttatcgaacaccaccatttatttcaccatttgcaattgtttcaattgtccttgcactgggggcaactaacgtggtcgttaataagacaacccatactgtcaatggcgccaaggccactagcagtgtggtcaaaagttcatcagctagttccgcaagtctgaaaaagaaagcggctgatgatagtagcgatgagaataaatccaaagacaaatccagttcagatacatctaatgatgaacagaatagtagttccagtagtagtactgacgagaatgatacggacagcagcagtgctaataagaccagtagttcatcaagttcagctgatgatacgagttctagtgccactaatagtagtacgactgataacaatagttcaacgactgatacgagtgacgatgatgaaagctctgctgctgagtcatcaagtacgaccgcgtcaagctcgacaacgacaacgtcacagtcgacaacggataccactactagcgacgggggcgaataacgaatgtttagtattttagatatgatcaaccacgccttgggttacgttaatgtcaatgtgaagattaagaaccaaatctatatcggcattggaattgcgggtaatttatacctcggttatgtggcaattcgcttgatgcagaatggcgcgtggttacggggcatcttatatatgctcgttttcttggcgctgatttatttcattacgttaaacgtcatttattattttactaataaaactgcgaagtatgacttatcaccacgtattgaaaaattgttgggtggtaagcctaaagaagcgttagcagctgaaaaacaagcacaacaaagtcagcaacaaccatacattcctgcgaacggtatttttgatgggcaggaattgttgcccgccacggtgaagacttcacgtgctgaacaagagaatgtgcatcaaattgttgatcaactacaagcggcgaacattgtccgattagattacggtggcttaactgatgatgccatcattcagcaggcgcaggcaacgggtgaacccgtttatgcgattgggcaaggcattcaaattcctttctcacagttaaagttggagaatcaccggctagttatttacgccggaattaatcagatggaccaatccccggttgggcatattactaaggtcggcttgaccgatgttcatgatgcgcatgaggattataagttgtatttggcctccacggtaatcacagggggtatgagcaagattgcgggccgaacgtcagctatcgagcaaccgggcgattaccaggtaaccgcgcaggttgcgtatgagggaagagaagattaagagtgcttccaagggcggttagtttgtgagcatcaccgttttattgttaagcggagcaaactgcctttggaagcacgtttcggtagccaaattgaatctaaacacaaaacaaccgttttgagcagtggctcgaaacggttgttttgtcggtatggctatttaaaaagcgctaaaatgtctaatggtttttggaagcggtgggccactttttgatggtcggcgttagggtccattccccagactgccagtccaaaatcaacgttagcggcctgggcagtttgttcgtcactgacggaatccccgatgaagagtgcgttttgtggcgcaacgttgactttttcgagggctgtgagtagggggaggggatctggtttgcgcttaggcgtatcgtccgcactgattgtgacagccatccgcatcatgaatggatacgagcgcatcccactttctaattcgtttcgtcgttgggaagtcacgattccaagtcttagttcagacggcaactgttcaaagaggctggtaatgcctggataaagttcaatctgatcataatggctggccatgacatcttcgtattgggcctgaaagtggtcaaactcactggctgcaatccccaattcagtcattgcttgttcagcggccatgggaaaagtcttctgcgcttgggcaggactaaatggtttgccataagtagcaagtacctcacgcataaccgtcgtgtaagctggttggctattagtcagcgtgccgtcaatatcaaacattaatgcttggtaagtcatataatcgttccttccaaagtagatttaactccagtatagcaaattcgtccttgacagtggttaggacaaccattatagttagattaacaattgatgaggagctaatgatatgtcattaccgttaaattcattaaaatctagaactagcttttacttttggtattttcgctagtgtttgtgccggctgcagaggtgcaaacacgaatccgatgtttgcatcgatgcggttgccaagagtattttgtgatttgacggcgcccatggatgtttgaaaattccaagggtggctaataagtttgtttctgcgtggtggcgcaccctttggaatttcaaggggtgcgcttttttgaccctagtccagtccgcttccaccaacaagatcagccaaacttgggaggaatctttatgtcaattaattcagaaacacttgttaaccatatgaatcatgaaattgcggcgattcagccgtctgatattttggcgttcaacgctgaaatcgcaaatattccgggtatcgtgcgtttgaccctcggtgaaccggattttaatacacctgagcacgtgaaacaagctgcaatcgaaagcattgaagcggatgaaagccactatgcaccctcgaacggaacgttggccttgcggacggctgccgctgaattcttggccgctaagtatgatgtccattatgatcctgctagcgaagtgattatcacagctggtgcgaccgggggcatttatacagcgttgacttcaatccttaatcctggggatgaggtcctgattccaaccccaatttttccactgtacatcgcaatcgttaaattatctggggcaacaccagtcttcatggatacctcggacaatggcttcgtgttatcgcctgaccagttacaaacgacgttagcagcccaccccaagacgaaagcggtggtccttaactttccttcaaatccaaccggtgtgacttaccggcatgatgatctgaaagccctggccgcagtgttagctgatcaaccaatttttgttttgtctgatgaaatttatagcgaattgacgtatggtgagcctcatgaatcgattgcaaattacttaccaacacaaactattttgcttaacggcgtctcaaagtcgcacgcgatgacgggctggcgaatcggcatcatgtgtgcgccgaaagctatcacagcacaactgggtaagattcaccaattcacagtgacttcaacgacgaccaatgctcaagcagctgcgacggaagcattgaaaaatgggttagatgatgcccaagtaatgaaacgtgagtaccaagaacggcgcgattatttgtatgatgcacttaatgaccttgggttccaatcagctaagccagaaggggccttctatctcttcagtaagattccagccgggttgccacaaaatagtatggctttttgccgtgaactagcccatgaagcacgtgtcgctctgattccaggtagctcattcggcccgggtggtgaaggctatgttcgaattagttatgccgcttcaatggccgatcttaagacggcggtcacgcggctcaggacgtacgttgccagcaagaagcagggggcttaaagatgaaaattttaatgtatagtgttcgcgatgatgaacaggatgcgattcaagcgtgggctgcggctcatcaaattcaagtagatacgaatgatctggaattccatccagaaactgccgacctggtcaagggttatgacggcttggtcattcagcaacgcagtccaattggtggtgatgctagcttataccaatcattagctgcggccgggttaaaacaactaacgagtcgtacggctggtgtggatacaatcgatattccggcagccaaggcggctggtcttgtggtcacgaacgtcccagcctattcgcctaattcagttgctgagatgtcggtggcacaaaccatgcgcttgattcgcaacttggaaatgtttgatcaacgaatcagccaacagaattttcagtgggcgggactgcaagcacgagaaattcgatcattaaccgttggtattattggtgcgggtcgtattggtggcacggccgctcgacttttccacgggttaggtgccaaggtgattgcctatgacgtggtacgccatcctgaactcgaagacgttttaacctacgttgacactaaggaagacctattgcggcaggcggatgtcgttgatttacacgtggatttgaatgagacctctgcggggttgatcgatgcggcagccttgaagttaatgaagacggatgcctaccttatcaacgcctcacgcggaccagtgattgtcaccgatgatcttttggcagcgctaaaggccggtgaaatcgccggttgtgcactcgatacggttgagggtgaaaatgcgttatttaaccaaaatcatcagggtgaggtgcttcaagataccaacgtggcacaattaatgcagatgcccaacgtcattatcacgccacacgtgggtttctatacgaatttagcggtcaaaaacatggtcgatattagcctggatgacgtcttagcaattctaaatggtgaaacgacggccaacgccttttaatgatggcgtcagccgctactaccagtatggctgtaggagacggtggctggtcaaagtgccccaccggttaacttgttcggcgactcgctgttcgataactagcttatagcgggactaatttggtggtgcgtccgcgactgggcttcaggtgtactggcaatgaaataagccttccaagcatattgcttggagggcttatttgtctcttgagtcggctgactggtcgtgactaactagctagtagattcggctaaccagccattatctaataactggtgatagtgcttaccgattggcacccacagtttagcttgcagaatgctacggagctcatcccagaagagtggatcgcgttgttcattggtggataaattcaattttaagtaggcccccgtctcagtcttggcaatcacaaagggataaaagactttgataatctgggccgctataatgttagtcatgttagctgcttggtcaagtaacatattatcgtctcccgttacaatgcagatgattaatttcttaatagttctaggttagcagtgattattaaagaaatgattgcggaagcgttaacaatttttaaagttcagttagttaaaaccactaattgtgaaaattatgcgccggacgcttcggtggctttcagtagtggtatgattaaaagcgggttaagtttagttgttagaataatataaattttattgaaatcattgtctaaaaattattcggccgtggcagttccaaaaagaaaagcgaattattattggcttttcacgaataatgttcaatattggagctgttattcagctattttaactgaaaacagtgtagctgtttctcactattttatggatatcgaacaatatttagctactttttgacaaaattactaattatgtattaaactatttaaatagcattaacgaagaataaggatttcttaactctaattattaatgcaataattctagaccgtcagtcaacaggctgatagagaaagcgaaggtgactgcaatgtcaatgatcgaatttcacgacgtcgaaaagtattatggtgattttcacgccctcaaaaatattaatttaacgattaatgaaggtgaaaaagttgttttgatcggaccatctggctcaggtaagagtaccttgattcgaaccgttaacggtttggaacgtgtccagtcaggtcaattgttagtcaatgggtttgatttagccgaccgcaaaacggatatgaataaaattcgcaaaaacgttgggatggtgttccaacactttaatttgtacgctaacaagacggtgcttgaaaatatcatgattgctccccggttagtcttgaaacggccggaagatgagaataaaaaattagcgatggacttattagatagtgtcggtctggctgacaaggccaatagcttaccgagccaattatctggtgggcaatcacaacgaatcgcgattgcacgttctttagctatgaagccgaagtgtctcttgtttgatgaacccacctcagcactagatcccgaaatgatcgatgatgtgttgaacgtgatgaagagtgttgccgaagactccagtatgaccatgttagttgtgacccacgaaatgggctttgctcgtgaagtggccgatcgggttattttcatggctgatggggaaatcttagaagatgatgctaaagaaaagttctttgatggtcagccgtctaatgaacgggcccgtcaattcttgagtaaaattattacacactaatttgtaggggaggaccacgaatgaagaagctgaaacgactaattggcgcactcggcatgcttgccatgctagtggtggtcttaactgcttgcggttcacggcaatcattagcaaaacaggatgttttgaccaatgataaagctagtaagacgattacgtggggtgttaaagctgatacgaaattatttgggttgatggacgttaaagataatcaaatcaaggggtttgacgccgacattgcgacggcattaacaaagcgggtgctcggtaagaatgctaccgccaagtttgtccaagtaacgagtcaaacgcggattccattgttgaagaatgggaacattgatgccattatcgccacgatgactatcacgccggaacgtgaaaaacaggttgattttacgaattcatactttgatgcggggcaatcactgttggttaaaaagggcagtgccattaaatcagttaaggatttgaataagtcgggcaccaaggtccttggtgtgaccggtgcaaactccgttgagaacattaagaaagcagcgcctaaggctaaggtgttggaattatccgactatgctcaggcaatgacggcgttgaaatctggtcagggggtcgcgttgactactgataacgggattctttacgggatggcgtcgcaaaacccagggtacgaagtggttgggggtaccttcacgaaagaaccatacgggatcgctgttaataagggtcaggaaccgttaaaaaaggctctgaataaagcgctcaaagaaattgaagcggacgggacgtacaaccgcatcttgaagaagtggtttggtaacgtggccggcttcgactataaggaggcgtcacgctaatgggatacattctaacgcactattggtcagagctgattcaaggactcggatatacgttgttatccagtgtgattgctttggtattcagtacgatcatcggaacaatgtttgctatctttgaagttttgccaagtcgtacgatgcgcatcattggtcgagtttatattgaaattttccggaacattccattgttagttattgcgatgttcttctacgtgatcattccaatgtatgttgccaagattgatggttttaccgcggggacaattgggctaacaatctatacctcgtcattcattgcggaaacggttcgggccggaattcaatctgttgatcctggacaaatggaaggcgcccgtgctaatgggatgacgtactggcaggcaatgagtaaaattgtcttaccacaggcatttaaaatcatcattccaccgttgggcaaccagtttattaatctggtgaagaactcttctgtcctagctttcgtggctgggttcgacttgatgtaccaagcaaattcaattgcgtcactatcgcttgatacgatcaatagctacgtggtcgtaggggtcttttacttaatcattacgttgccactgagttattacatgcggcacttagagaaaaaattagcaaactagaagggggcgacgattcatgcaaaactttattcaagcgtattcgtggataaatatccggttcttgctcgaaggactctgggtaacggtggaagtgtccgtcgtttccatcattgccagttttattatcggttcagtcctaggggtgcttcggtacgtcaagattaaatatttatcggcagtggttgggtttgttgttgacattattcgaaacttgccattgatcttaattatcttctttacttactttggcttgccacacttgggattcaagcctgggatcattttcgcagccatcctcgctatgacgatttttgaatcggccatgttagccgaaatcattcgttcagggattttggcggttgattacggtcagatggaaggcgcccgggctaacgggatgagctatgtacaagcgttatggcacattgtctttccacaagcaatcaagaagacgatcccaacgattgtgagtcaatttatctcactgattaaggatacgtcgctggcaaccattattgttttacctgaattattaaaccatgcgcaaattatttatggtcagaactcagcgtatattttaccgatgttcttaatgatcgcagtcatgtacttcattatttgttacgccttgtcaattctgtcacgtgtgttggataagaagttagcgtaattaaactggtgggatgatggctgaaattccttaatgaaaagaccaaacaagcaataatgctttgtttggccttttttataaaaaatatttaaatgtcttgcaaaaaatagaaggcgtgataatatagttactgaaaacgttttctataaaactgaaattaaggattgtaactcatactctttgaggcattaccttttacttgttgaaatatacgggtgaagtgggtgcctcaaggagtttttttgtattgaaggaggttcagtgatgtttggaattaaaagaaagaaagttgatgtcttcgaggtggttacaccaattgaaggtatttgtataccgatcacggccgttatggatgaagtgtttgcaaagaaaatgatgggtgatggatttgctattaggccgagtgaggacactaatcaagttgtggcaccgattagtgggaaaatcgttgcattacctgaaagtaaacacgctattggcatcatggatgagactaggggcgtgtctgtattggttcacattggcctagatacagttggcttaaatggtagaggctttacggcacacgttaaattaaatcaagaagttaaagcaggggccctattagtgacgcttgatcgccaaacgatggcgatcgcgggattagatatgaccaccatagtcgtctttacagaaggttatacgggcgaagtgccacttggcagtaagtttcatcaacaattagcagccggaacaccagttttaaagcaagcataaactatgtaaaggagtgcgaattaaaatgcgggtggtgaagaaaattaataacaacgtggtcgtttgtcttgatcaacatggtgaagaattggtcgcctttggtaagggattaggatttcaaaaagtcccgtatgagcttactgatatgactaaagtgacgatgacattttataaattaaactatcaatattatcaattactaaaagaaatacctactgaaatctttgatttgagtgcggcaattgttgagcgagcgcaggcactaattccaagaattttgaatccaaatatgatttttagcttagctgatcatattaactttgcaataacgcgactaacccattataaaagcgcccagttaccattttcatatgatgtggagcaattatacccacaagaaacggatgttgggtattacgccgtcaggttaattaatcgacggctaaatattcaattaccagtttccgaggtcacagcaattgccatgcattttgtcaattctcagactaatgatttagcgaccaattcaagtgtaaatagcgacgatgaaatgataaaaatcatcacaaaaattattgaacaagaatatgagcttagaatcaatcaaaccgaattcacatacaaccggtttgtcatgcatttacggtattacattaaacggatgaagaaacatgagcaaatttctgaaaatgataattctaaattattcaatacgatgaggcatgatgagcctgaaatttacttggtagcaaagcgaattgcagactgcgttgatagtcaacttgatactaatagtaatgatgatgaacttttctacctaatgatatatgttaaaagaatcgttaataaaataaatactcaagcgtaaccgttaattaatggaggtgtatgcgacatgaaaaataaggataaacagtatgaaaaagtggcgaatggtgtactggaagcagttggtggtagtgcgaatatttcttcggtgacacattgtatgacccgattacgttttaatttgaaggatgaaagtattcctaatgatggtgaggtacagaatattccaggtgtgattggtgtcaatcgcgctggtggccagtatcaaatcattattggacaagcagttagcaaagtttatgatgcgttacttacggtggggaatttaactagaaacgcgccaattccaattaatgaagatttagataatcgacctaaagaaaagttaacgtttaagtctgcgggaaatatgattctaaataaattggctggatgtttaacaccattgattccgatgttgattgctgcatcaatgtttaaaatgtttgcggccattttaggaccaagtatgttcaatattcttggtactaaaacatcgttgtatcagttatttacgttggttggtgatgctggattctacttttttccaatcatcttaggatatacagctgctaagcaatttaatacgtcacggattatttcaatgtttttaggtgcaattttgattgatcctaatttaattaaaattgtgactgctggaaaggcatttaatatcttcggtatcgcaatgccattagttaattattcaagtacggtcattccaattattttgtcggtttgggtaatgtcgtatattgaacggttctttaagcgttatgtaccagagtcaattagtacgattgttatcccaacgttgacgattgcaatcatgttgccgatttctttatgtattttaggcccagcgggaaactttatcggcaattacatttgtacaggaatattagcttttgggaaattaggtggcttgccaacgatgatcgcggttggagtggttggtgccttatgggaaatcttggttatgaccgggatgcatctcttaatgcttacgacgatgatgatgatttttgcgcaatcgggccatgaaaactttgtcacacttggcgcagttgctgctagtatgtcggtcgcgggcatgtgtttaggtgcggccttacgaattaaggaccaagatcaaaagacccttgcttggggttatttaatcgctagtattatcgggggtgtgactgaaccgggattatatggactagcaattcgttataagcgaccatttattggcatgatgattggcggattttgcggtggcttatatgctggcctgacaacagttacagcttatgtcatggtacctgttgcaaactttttatctttaactgcgtatgttggcgggcaaacatctaatgtgattaacggtgtggttagtggcgtgattgcgtttgtagcagctgctattgcaacttatgcgattggtgttgaagccaatacaaacaaacaggggactaaagaatttaaactagtggaggcttaaaagctaatggaaagaaaagtaatcgttcgagctgatgatttaggttattccgatgcagttaatgttgggattgcacgaacagttcacaacgggttaattaataatgtgggtgttatggtcaatatgccaacgacgatgtcaggattagccatgattaaagatgcaggggtttgcttaggtttgcatactgttatatctgctggccggccattaacaaatccaaaattgattccgagcatcactaatccagatggtacctttcgtcattcctcggattatcgggcggctatggcggctattcatgattttgtcgatcttaatgaagttgttttggaaatcgaagcgcaatatcaaaaatttgtagcgttagttggtcgccagcctgattattttgagggtcatgcggtagttagtgataactttgttaagggattggaaattgtgggtgaacgtcatcacttaaatattttacgctttgcagcaggcccagatagtccgagtgtgctatttaagggaaaggtattacatgtttttatggaaagtatgggcaaaaactataacccttatgaaacgttgaaacgtgcggcactagcccaatataatgacggctatgctatgatggtttgtcatcctggctatttggatgactacttattacaacattcaagcctgacagttccccggacgcaagaagtcgcaatgttaacagatcctcaaatgcaggaatggttagaacgacagcagatcaaattaatcaaatatagtgaggtttaattactaagcgttaaggtaatcggtaagcagattaaattacttattcaatgcgcgttgcaaagcataaaaagagcgttgctactgaaaatatcttcagtaacaacgctcttttacaagttatcaagaatttaaattaagcattttgattttgctgctgcttccaataatagattgggaacccaacggccacgataaccaaggaaatcagtacaccagataagtctgagccaatttcactgataatcacgaacagtgcgcccagaatcgcaatcagcggtgtgatcggaaatccgggtgtcgagaatggtcgctcagaagctgggcgtcgttttcttaaaataaagacaccaacgaaggttgccacgtagaagcagtagaccgtgaagatacagaggtccgataagcgatctggattaaagaacaggatcataatactagcataaacgagaatggcaatggttgcggcgatcggctcgtgtgattttttgtgcaagtaactgagttgtttagcgaatggcagctgattctgagcagccatggcgtacacgatgcgggggaaggtcataatcttgccgtttaaacagcccaccatcgagatgataatcccaatgttcagtaggcgcccgccaattgtgccaaacgccgcttgggcaaagtacagcgtcgtttgttgcccgagtttgtggatcgttgccgcgggtacgaagtggagaatcccatagctgactaaggtatacgcaatcaagaccattgaaatccctaaaataatggcttgtggtaataacttctgcgggttcttgatttcgccacccaagttagcgactaagatccagccatcataggcaaaaagtgttgcgaggacggcaaccccgaaactacccgttgattgggtaattgtatgtaaagactgtcccagcgcattctgattaccatagaagagtccaaaaataataatagccgcaatcggtaataatttgcccaacgtggtcgcaatttgaaatgcggcgccccaacggttttcgaacatgttgaggattccaatcaggacgatgacgccaatcgagagtggcgcctgccaacccgcctgcaggttgaagaaaccaactagtaatataccaaggtaagcgctaattgaagcgatgatagcgggaccgtagacggcgatttgcatccaaccagagagaaagccccacaatttaccatagatttgttccatgtagacatagagcccgcccgtatgcggcatttgggcaccgacctcggcgattgttaagcccgcggtcaacgtaatcagtccacctagtaaccaggcgagtaacgcagcgctcggtgagcccgcactatcaaggactgatgattgcttgaagaagattcctgacccaataaccgtaccaacgacgagtgaaagtgctgaccaaaaaccgagtgaacggttcagggtcgttgcttgctttgtttcctgcattaacctgaaatcctcccttgaaacaaccaaattctaaatgattgcacttagcataccagagattaatggtgatgacaatcaaatatcgttggttgtggccggtttttcgcctaaaatccgaactaataacgatattttaataataaagttcgacaagactcaaaataatcagtgttattcggttggtgattcgagtttcgacaaaataggattgggcggcgtggtggctttaaattaatttatttatcttcctaatattagcagggttatttaacgggtcaggttagtcattaacttagtcattaattgagttagttgtgcccactcggattgattgagaccacccttagcagtcaataaatccggcaaatcatttaaagcaattcgtgttgcggttccctgaggtgtcagagtgagcaagatgctccgttcatcttggggattccgatgacgtgtaattaaaccagcttgggtcatccgctgtagcacgggcgtcagcgttcccgtacttaaatttagctgggtgctcaacgttttgaccgtgacagcgtgcggcggtgtcgcatagagtgcgactagaaccaagtattgtggataagtgagtcggtgtgctgtcaaagttggttggtagaggcgttgaatggcatggactgttgtgtaggttgaaaaacagacgtggtcttcaagggggcgaattgtggttgtcttcatgataattaccgcctttcatgcgatgagtattaagtgcggagacgttctaataatgattgtgcacaatcgattgattggattatagcacattctgacaatctgtgggcctagttgccctagtgccggtgggatcttatggtctggtggtcacgttcagtatgcaaactgatgattgtgggtaccacttgcagtgacgtcatggtaataatttttggttccttcctaaaaatacagtataatgctacgagtaggtaagagagtggggttagattgatggtaattgcaattgtggtgttgttgatgctgctcagcatcggcttatttgggttgctgttagccggtgccagacggcaagcagcgccattttttgaccacagttttggtttcggcatggttatcggggccgtgacggattttcttgacacacttggtatcggaagtttcgtcgtgtccacggcaatttttcaagcgagccattatttaaaggatgaacgtaagctacctggaactttgaacacgatgcatgcgattccgaccgcgtttgaggcgtttttctttgttacagcagttgcggtcgagccagtgacactgattagtttagttttagcagcaacgctcggcgcattactgggtagtgaagtcatgacgaagcttaatcagcggtggattcagttaatcatggccggtgcgttagtcatcactgctttactgatggcagcgaagttattaggttggatcagtttgctgggagttgctaatcaggcgacggggctatccggttggaaattattggtcggcattggtggcaactttatcctagggttactgatgtcagccggagtcggactgtacgcaccgtgtatggtaatggtgtattttctgggattgaccccgattgccgccttcccaattatgatgctgtcgtgcgcattgttgatgccgatttcggcagtgaattttattcgccatgaccgcgtcgattatcgcggcttattcggcattattttaggcggtattattggcgtggtggtggcagcgaccttagttaagtcactgtccttaacagccctgagttggttgatcgtcttagtgagctgttggacggccttttcgttatggcgtgccgcgcaacgccggaaaaatgtgttatagtcaacggtatgagtggttaggctaaccaagcctagccacttttttgtcgttgtttaaaatgatcgtcaggctgctagaaaaaataacggtcgctggttgacaatttatacagctggctgtataaatgaaagggcaggtgattaagatgaatcatgatgaaatggtggcgcggcaagttctgattttagctcgtcaaatcaagcggcgtcgcaaccaacatttgcggacggtggggttaacgactcagcaagcggatgcactgaccttttttacggatcagccaggtcgcacggtaaccgcgtttaagacgtatcaggaaattacccatcagacggccaggatgatcgtgcaacgcttgcagatgcgcggatatgtacaattagtggtcagtccaacggatgcgcgtgccaagcaagtggtagtgaccccgagtgggcgtgctaaacgcgagcagctccgtcaacatggctggcagacgagtgcgcaaatgtttgcccatttggatgccgaacaacaacaggtatttttagatttgttacggcaagttaatcagaatttagaaagtgatgagaattgatgaagacgcgtttatatacgccggatgtaaagttagtgttaatggctagtttcttctttttaatgagtccaatgttaatcaatcccgtgattgcaggatttgcgcacggtattggcgctagtagtgtgcttgccggtacgattgccgggttaacgaatttgacatcgctagtgctccggccacttgctgggaatttaaccgaccgggtctctaagtaccgtttgaccttcgtggggggctgtttgttgctactagctagtttaggttatagtttgacaaccaacgtgacgttaatcatgttattgcgaattttgaatgggttgggatataccttgtgttcagtttgcatggcaacctggatggctagtttattgccacccgatcgaattggctctggaatgggcatttatgggctagcgaatgcgcttggaatggcgtgcgggccggcaatcagtgtcttcttgtatcaacattacagttaccagagtgttttttggttagcagcgggctgtagtttactgctcatcatcatgattcaattcgtcggtgatcatggtgaaccaattgtgacgcctcaaacggctacgactaagcaccatattcgcatcgtacaaccacgagtaatccccgtggccttgattttgcttttattttcattaccatattttgccacccaaacctatattgtcagctacgtcgctgcacggcattttcatgtggcagcgggggtatttttcccggtgtacgcgggtattttattagtattgcgaattattctccgcgattggttcgaccgggtgccatttaaacggttcatctggttatgcttaatttttaatctattaggattgattggcttaactgacatgaacaattgggcgatgctactgctgggtgcagcaggactggccgccggatacggtttgatgttttcaatttgccaagctaaagcattgatgctcgtgccgaaagctgatcatgggctagccaatagtacgttttatattggtgttgatctcgggatgtcacttggccccatcattggcgggctgattagcagtcaattaccaatggcgtggttttatcccgtgatgatggtgacgctgccattgattatcgttgtttacctagtcagtcgtcggcagttagcttagccaccaacatgctggagaaggttgttcttggtatacacatgattatgaattttttcagtaggggatatcaaaaagtcacttcaagtttacgactgcctgaagtgactttttatctgcctttatataaacattttgatgccaaaataaataataataagaccaagaaatggcgttaatacgcggttgaccttatctaaatttaaatggcgaatcacgagtggtgtaatgattgcgccgataattgcgccaatcatgaggaccaatcctgattgccaagcaaaagtactagtaaagagatggccgattaaactgattgtggacataacagttaacacataggtggcagtaccagcggcttcaacggccgttagcccaagaattgctaacccggcagccgtggtcgcaccaccgcttaagccgccaatgccgaccatcaatccacttaaaaggccaaagaaggcagcttgccaaggttggtgaccggctgtagtttgtttagaatggtgaacatacttgattagtaccatcgcacccataatcaaaaaaattgtcccgacaatccagttatacagttgttggggaataaattgtgcgctgaatgtcccgacgatgataccgggaacggccgcaatgatcatttgattgccaatcttgaaattgacatttttgattttcaactgtgttagaaaaccaaagaataaggctggtaaggcgacgattagggaggttggtacggctaccgcggttgcaaggcctacttgactggttaagacacctaggtatagggcagcacctccgccaccaatcagactaacgaagatgccgattagtaatccggataaaaagacaaacgtagtgaattcccccttaaattgtataattataccttaaacggagtacactccgtttgtcaagtgatgcgtaaaagtgtatggtgaacttaagtaaataggagggtgtgtcgaatgcgaaaggatgcacaaattaaccaacagaaaattttgactgctgcgcgacaactctttgccgcgcgttcaatcgaaaccgttagtatgaaagatattgcgacggccgctggtatcggtcccggaacgttgtatcgtcactatgcccataaaagtacactatgtttggcattggtaacggaccgagtcgcaacttttattaaaaccaatcaagtctacttgaccacgacctcggtaggtgcagcggcacgttttgatcatgttattggggaatatttagcgattcgtgagcacaacatggcgttattaatgaatgtcgaggccggtgaacctggtcgccgtcaattttatcagagcgaactttatcaacaattatgtgacctattaacgcaactggttcgtgatttgaagccaacgctttcgaaaccggcatgtgagtttcaagctgatatgttaattgccatgctgaaggggactagttatgcttttcaacgtcaatggcgaggacggtcgcagtccgaactattggcgcaattgcacgcgttaatggtgactgaatgatgttcactattggcactagtggtttggcgattaacagagtgggttgattgttaaatcaaaaaagatggttctaggcggttaatcctagagccatctttttgaatgagtcgtttaagcaggtgtcaccacgtatttttcataacgttgggcatcgacagtgttgagttcgactgttaattgggtgccatcagctaagtaatccgttttgagaatgttggcgtggtcattcaagtaagccactacttcaccatcattgaacgggattaataacgttgttgtcacgtaattcttaaagactttggctttgatcatactggtcaaagcttgtagtgaggcctcatcacgcgccgtatagatgagttgatcatcttgctggttcgggtagtcggcttcggttaaatcagctttattgaaggcataaatcataggaacatcgtgcacaccgatttctttgagcgtcttttcagtggtcgccatcatttccttgtaatggggatcggcgtagtcgatgacttgaatgagtaagtcagcattggcagcttcggctagcgttgaacggaaggcgttgatcaagttatgcggcaagtcgctgacaaacccgactgtatcactgagcagtaactgcttattgtcagggaaggttaactgacgaatacttgtatctaacgttgcgaaaagcatgtctttttcgaagacttgcttatcttcacccttaccgaacagtttcactaaaccattcatagtcgttgatttaccagcgttggtataaccgactaaagcgacgttggggagcccagctttatcgcgttgtgaacgtcgcactacttcgtctttattgagttccttaagttcgtgcttcgcgtgactgatccggtcttgaattgtccggcgatttaattccagttgcgtttcaccagcaccacggttggtaaagcccccgccaccaccagcagcggccccagcctgttggtcaaggcgattggagatactcgttcgtaatcggggaagttggtattgtaattgggcaatcttaacttgcaatttggcttccttgctccgcgcacggttaccaaaaatttctaagatcagaccagtacggtcgatgatctgaatgtccgtttgttcctctaagttacgcacctgactaggggtcagatccgcgttgatgaccataatgtgcaaatcgttggcggctgcgacttctttgatttcgacaactttacctttgccgaagaaggtggccgggttgggtttttccaatccttggtcaattcgcagggccgcgtgcatattattggctgcaacgagcgcttctagctcggacatggcgtagtcgtaattggcgaccgttttagacatgccggcaatgatgacttcttgtactttttgagcgttggtttcagacatacactcactcctaacgtgttatgattgcattaagtataacatgtctaatcaaaatattacgacttcgggtattagggaggaatcaaaaatgggttacgtgcttgatttgcggcggcgagttggtcaccaaccgctagtagtggccggtgcggctttaatggcccaaaattcgattggcaaaattgtcttgatttatcgaaccgataaccactgttggggcttgccagctggatcgactgaaccgggagagacggtccagcaaacggcgcgacgggaattgaaagaagagactgggctgacggtgggtgagttaacgctgatcgatgtctatagtgggcccaagatgcactatcagtatcctaacggggacattattgacagtgtcaccacgttatatcgcgccaatacaacgggtggtgaattgattcaagccaccgatgagacgagtactgcggctttctttgctttagatgctttgccgacaccgttgaccccactgacaaagtggatgctttgcggtgagtaagcttgaccatgccgatgaggtttgctatagtggactgaaatattaagatgaactgtcaccggacaacgttaacccaacttccttaggtcattgtggaagttgggtggacgttgtcctttttattttgaggaggaattgataatgacgtggatttatttaattattgctggattatttgaagtggtatgggctacgatgatgaaattaagtaatgggttcagtcactttggctatgctgcggccacagtagttggcatggtcttgagttttggcttcttagcattagcaaccaaacacttaccgttgagtattgcatatccaatttggaccggtatcggtgcggtcggtgcgataattgttggcctggttttcttcaaagatacaattgcacccatcacgtggatcttcattgcaatgctggtcattggcattattggtatcaaagtcacgagttaggattgggggggtgttagtgggtttgtgattcatcagtgaagccccaacagcttttcaatatttttataaaagaatgaccacaagcatgaaagcggtgttataataactttagaagttaaatgaatatttgggttattcttagacttcttccgacctgagatagacgcactgttgccaagactttacaaaattttcttgttacacccggtcaacgcactacctctcggaggggtttcttaatttcgtcagtaattctgtgtatagtcttggttgagtacaacaaatagtgaaagaagtgacgtctgatgatgatgtatccgtatctgaatttaggccccagagatggcgtcttgataattgcagctgctattatgttagctttaacggtagtttttaattggtcagtctgggaacttttgtttgctgttgtggcagtcgtaattgcgttcttagcaggaagcatgaaaccgtctaagaagaacgtgcttgcttttttgaaaaaatagtttgaattggggtagcatacctgaattcttcaaacacgtctttaaccagcaaagtttaaggacatcattgataagatagccgagttggttctctgtcaattgatgttgcgaatagtgctacgggtgcttagtcaaacaatggcgagcacctttttcaattcgaattgttcaatagcccatgattaaaatacaaataaagatatctgtcgccagtaatcacgtatttagttaattaccaacaacagttatttcagagccaatataaaaacactcgcgaccagtcagtggttgcgagcgttttgtttgatgagcaaaattataagtgttgattgactttcacgtcagctaagtcttgcgcataatcgacgacgcgaatttgatcgccattgatgtcgatgcgagtgacgctcccgtttttggggccgttcgtgatgtcgatttcaggagcaaaatgtgcgaccatactgcggattgtcgtgccgtgggtaaccacgaggactttttgatggtgatcgtggtgagctttcaagtagtcaaagccctggttgatccgttcccagtacatcgagttgtcttcagcttcatgccaagggtcgatttcacgcatcaggtcgcgagtctgatcgataggcacgtgttcaagaagttcgtgcatgctggtgaccccgtattggcggccaactagtgaccaggtccgacttgaatcgtcaccttcgaaataaccatagaaaacttcacgaaagttcatcagtgttttaaagggctgggcggtggcacccgccgcttgtcgaatgagctgagcggtgtcgattgcccgcttagaatcactgctgtagtagtagtcaaaagccgtgttcgctagtgcttgaccgaccttggttgcggtggcttgtccgtattcagttaacggcgagtcagaccagccttgcatgcgattatataagttgaaaaaagtctgtccgtgtcgaacaaagtaaattgaaaattgagccatgtgtttctccttatttagtcgagatggtctttgcggccaaagtagtctaacgtcacatcgttgtcgctaattgtgaatttcgtgacgctcccattttggggccgtgctggtgaggtcagtgcggcaaaacgagcagcaatactgtaaatcgtattgccgtggctgacgaccaaaactttgtccccgtcgtgatggtgagcacgtaacgtatcgagaccgccattgacccgttgccagaattcggcgttattttcggcgcgatggaacgggtcagcttctttacagaaatctttggctttttcgatgccgtattgttcaataattgcggacaaactaggtgcttgatggggcgcaccaaccatgaaccaggtctgcgacgtatcatcaccttcaaaatagccataaaaggcttcacggaaggcagccattggttgaaccgtcaaatcggtattgccactggcaggaagaattaattctgcggtgcgcattgcccgcgtcatgtcactggcgtaaacggcatcgaaatcaataccgttgagcattttacctgcattgcgagcgtcctgttcgccgacagctgtgaggggggaatcacaccagccctgcattcggcggtacttgttaaagtaagtttgaccatgacgaatcatgtaaacggaaaaagttgccattatttactcctctacttggtgttcaaaactaagccataatgtatttagtttaccataaaatgcactgcgattaattagcagttgctaaggcttgtcgaatctgagcggccgtttgcttattcccggtaaagattaagcggtcaccgtacataatcgtcgtatttccattgggcgcgatcagtttccgattacggatgacttgactaatggtaatatcctgagcaaactgtaagttcttaatttgaacatcagtatagagatggttgaggacccggacttcgtagatgctgttttcagtatcattgagcaatagcaaggttgacggtgattcaattaaggcgcgcagtaaagtaatgttggcctctggtgtattgtagacttcgacgcctagctctcggagttcatcttcatgttcgttgagcacattgcggtcttcaaaccgaacgatgatccgccgtacaccgtatgctttggcggctttagcaagctcgtagttacgttcggcatcaatatggccgagtaccaaaatatccgtgtcaaagacgccgtgatcctgtaagtcctgggctgtgaagttttccattaaggtcactggcacttgcgcgtggtaggtttgataattctcaggatgattcgtgtacattgacacgtcgtaccagccttttcgtagctgttgtgcaacgggtacggtgcttaagttagcgccgataaagtggaccgctgttttgaccaggtcttctttttcagctgaataaaacttgttaaaaatcaggggtgagatgacacaagtgagtagcgctgcgagtaagaaagcgccggactggtcactagtaattgtcttcattgacttggcaactcgaagaacggctaataccattgtcattgtcgttgcagtcagcgcggtaccggctaaagcattggcttgcttgaaccgtaactttaggacccagtagccgccaatcttggcaaccatgtatgctaagaaaaatagtggaattaatagtaaggttttgccacttgttaataaggtccgtaagttcaaatcgacgccagtcgtaatgaagaaaatcgggatgaagaagccgtaaccaatagcatccaagcgttcgcgggtcgtttcactagggttcaagagtttcaagacgattccggccacaaaagcgcccaggatgttttcagcaccgacggattcggccaccgtgaccatcgttacaatcaagaagaaggctaaccgaatatctagttgtgtcgtcgatttgttaatattttgatagaagcggaagaatggtttgaaccgtaagagtaatagtgcggcaacggctaaaatgagtaatagtaaccagagactttgtgagttactgccgtagacggatgcatagagcgtcagtcccatcatcggtacaagttcaccaaagaccgagatgagcagaatcgtttgtccgaaagccttactaagcaattcctgttcttttaaagctgcaattacaataccaagtgaaatcgtgccaaataaaatcgcggcaagccagaaatcactgaagaggccgctgactttaaaagcagcggcgagtaacagcgatagaacaataattgtgctgtaggcgtacaccgaaagtcgaactggcgaatatttcggtgtgttgaccgcgtttttttgttctaaaggtgttaacgccgtgcgccgcttcttaaataggctaaagtcaatttcaagtccacttaagaacagcaggacgatggcgccaatcgttgagagttgtgagataaggtcagaggtgttcacaaagttaaacacgctggggccaattacgataccgacaatgatttccatgacggccgttggcaaactgttgattttgaatttagccatgataagcggaattaataatgcggctaataaaataatgactaaggaaacttgatccatgaataaatacctcgattcgttttagtacacacggagctgatcatcatcaaagccccagaaagcttcgctagcatgtgcatcggtgaaaactttcaggatttggtcgacaccaggggctaatttgtcaggcgtcagttggctcaatggttgccaactaatggccccctcgtatgagccggctagcaaatcaccgtgatagtgactagtggtgtataaggtaccaagcgacacgtcgccgtccgcattttcgacccacgttacggtgccaactaattttaattgatcgacgtgcaagccggtttcttctaatacttcacgcttcatcgcggttacttgtgattcaccgcgatcaacatggccgccaggaaaagttaaccccgaccactgtgcgtcaatcttattttcaaccaggacatcgccggtcgctggattggtgataaggcacatgttgacgagttctgcacggacggtccggtcgtggtgttcatgctgatccttagtggctaaccagtcttgggccttgtcattgatgcttgccatgaatgctgctttcatttgtaggtaggctgcgagatcggcttgtccattgcgcacacctttttcgcgaatggcagtatacttgcggccgtctgtccggtgcgcattgagataatcccggaaagtgagcaattgctgataatgctgttcatcagttgtaatgatcacgtggatgtcgttagcagctaattgcgtcgcgtaagtatgcgtcgttccagcgaccggtcgtgcgtgtaacgtagctacggcagccgcctgatctttaacaagcaacgccaagtcaattgttggacgcgctaataattggggcatggccgtactacccacgtgactactttttaatagattcgcctgtaattgctggcgtaacaaggtttgatactcggttgcttgcttttgccagtcagattgataggcagttaattgaattggttgcatagaatccctccactcgaataagtcattgaaaggatacactttttgagtggttttgaaaaggaaagacatgcctttcaaagcgagaagcaataaaaaaacacgattgcagatcaaccgtgttgtgtgtggcgcttatttgagattgagtgttgtccgttgtcgccaggtcttaatcagcgcaaccactgtggctggaatgagcgcggcggccataattcctagaaaacaaagcgagaggtggttttgtacgaagctgatcgagccaaagaagtaaccgagtgaacagccgacactgacccagataccaacgccaactaagttccagatagcgaaggtcggttgcggcattttagcggccccggcactcagcgggacaaaggtccgcacgagtggaacaaagcggccaaacatgacagctttcgcgccatacttagtaaaaaattgttgtgcgcgttgttgcttggattgggggaggtggcattgcaaccacggtaagcgaatcagatggcggccaatttcgaaattgacagtgtcgccaattacagcagccacaaagaatactggcaccagaatctgaatactgagggcgtcgctgtgagttgcagccatcgtgctggtgagaaagatcaatgattcgccgggaagaaatgggaaaacaaccatgcccgtttcaagaaagataacggcgaataataagatgtaagaccaactaccaagcgtagttaatagtgggacgatactttgttctaaatgggttaaaatggctattaaattgaccaacggcgccacctccaatttaagttgcatttattataagcgtctgcgggttgaaaaacagatgtaaccgattacatttcttccagtttaacacaatcgtaactttgatagaccaatgttcaaacaaatttacataaaaaatcaaaaactggcggctgccatgggttattaattgagtcgggccgccgatagtgataaaattattgttcgatatttaggaatggagggcgttcaatggctaagtcaattaaagctgcagaacaggaacacttagatcatgtggttgcgaaaattaaggtggctgaagagcaacaaagccaaaccattacgcgctcggaaaaagatcaggccgatattaaacgtgacttgctgaataacatcaatataaaaacggatagttacgaaggcatgatggagaccggattatccgtgcggcagcaacaacagatgatggatgagcggcagaatagttggaagcacgcgactaagcaattatcgacgttaaaaaagttggaaaagaatgcttattttgcgcggatcgattttcatgagactggtgagcctaagcctgagacgatttatatcggactcagttcattttctgacacgccggatcactttttgatctacgactggcgagcgcctatttccagtatttattatgacggtgggttagggcacgtgacgtaccagactccggatggtgaacagaccgttaatgtgaagttgaagcggcagttgatggttgagaatggccagatcgtgacagtctacgatactgatgaagccgttggtgactcgatgttactagaagtgttggatgaaaagtccgatgtgaagatgaagagtatcgtgacgacgattcaaaaggaacaaaataccattattcgggatacgagttctgacctcctgtttgtgcagggggcggccggttccgggaagacctcgtccgttttacaacgggtcgcatacttgttgtatcgttaccggggtaatttgacggccggacaagtcatcttgttctcaccaaatcaactctttaatgattatattaaccaagtattgcccgaactgggtgaacaaaacatggttcagatgacttatttccaatacgcatcgtaccggttaccacacatgcaagttgaaactttacagcagcggtttgaaactgaaaatacaccgcagatggcaaagattacgaagttggaaggtagcctcgcatttttcaacgcggttacaacgtatggccgacatttggaacaagcggacatgcgtttccgtaacattacgttgaacgatgaagtgattatttcccgggaaaagattaaatcgatttactactctttcaacgaaaactaccacttagcgaaccggttatcagcaactaaggaagaattaatcaagattttgaatcgcaaggttgaatcggagatgcgttccaagtgggtcgaagaagcggttcaagacttatcacgcgaagagatcaatcaattatatggcaatcagccgcgggaatttaagaatggcgataaagagtttaaattcttagcacgtaaaattgtgatgcaacgcttaggaaaagcccggacgcaaatcgtgcgtaaccgtttcttgagcatcaacatgcagtacgcgcatttcttacgcgaagtaccgaagatcatcaagttggctgatcacggtatctcagctgctgactgggatgctacggttgaacggaaactagccgagattaaggaacgtcatatctcgttaacaacggtctcagcttacatgtacctgcatgacttaatgaccggaaagcacgggcagcgtgacatccggtttgtcttcttggatgagattcaagattacaacgcctttcagctagcgttcctgaagtttagcttccctcaagcccgcttcacaatgctcggtgacttgaaccaggcgatttttaccaaggaaaacagccattcgctgatcaatgaattggccacattatttgaccctgaaaagacgcgggtcgtgcaattgactaaatcgtaccggtcaacgcaacagattactgatttcaccaaggaaattttagtcaatggtgaagccgtcacggcttttgatcgtcagggcgacttgccaaatgtcgttgtgacgcctaactttgaagcaggggttgatcaagtcgttgatcagctagcgatgaacgattctgaacgtgatacgacggcaattatcgggaaatccttagcagaatgcgaggcgctcacgaaggccctgaaagctcgtggtgagcaggtcacgttgattcaaactgaaaatcaacgcttggctcctggtgtcattgtagtcccgtctttcttagcaaaagggttggagtttgacgcggtcatcgtgtggaacgctaatcaggaaaattaccaacgtgaagatgaacggcaactattatatacaatctgttcacgggccatgcacgagctaacgctagtcgcggtgggtagcttgtcaccgttactagcgcgggtgaaccacgccttgtatacattaaatgaagcaaaagtttaagtcagtttaagacagtgagtaccgctccattcacctggagtggtactttttttagttttacttgtgaaggaaatcttaaggtgcgtcaggatgatcagtagtggaacagttgggacttgtgtcggaataactaagaaaacgctatcataacgatggaataagcgttaaaattaactcatcaagtgcagtagtcggtgagagacaatgaccttaatactgactaggcacataatatcgtgaaaatactaacaactagttagaacggttgttagtgacctgaggaggaaacgacgatgtcaatcactgaaatgttaggtattcaatatcccattttttctggtgccatgatgcgaattgcgacccatgaattagtcggggcggtttcggaagctgggggactcggtgttttaggttcagcggggttatctgccgaacagttgcgagcagagatccaagcgacccgcaagctgacggataagccgtttggtgtcaatttaatgttacagatgaagaactgtccagaactggcccaagtcatcattgatgagggggtcaaggtcgtgacgactggtgcgggtaacccgacttcatatattccgccgctacacgcggccggtattaaagtgattccagtgattgcttcggttcaccatgcccataagatggtggcggccggtgcggatgcggtggttgctgaaggtcaagaatcaggcggacatatcggtcaaacgtcaacgatggcattattacctcaagtcgtggacgctgttgatattccggtgattggtgctggcggtgtcggtgatggccgctcgattgcggcgatgtttgcgctgggcgcccagggtgtgcagtgcggtacgatctttctgacagctgaggagtgcccagttccagctagttataagcaacgggtattggctgccagtgacacggatacaatcgtgactggccgcagccagcgcgatccggtacgggcgctagttaacccgatgttggcacaatacttgcgattggagcaaactaacgcgccggtagcggaattacacgcgttagcggacggttcatttgcgaaagccgttgaagatggcgatatggaacatggtacgcctatggccggtgaagtggcagggatgatgacgacaattcggccagtcaaggaaattattacgacgttgtttggtcaggctcgtgaggtcgcggcacaactgaaaatcgaataagatacagtagcatagctcggtactaggtcagcgttaactagtatcgagctattaatggttattggctaccaattaggaatccggttaatttgaattttaatcagcgtttgataagggtttcatgttataatcaacccattaatttagtaatggtggcagacagaaatcatggaagatcagatgaactattatcgcttctcacgtgaacagtggaagcaattttatcgtaacaatcagcatcaagtaccattgaccgcagccaatttgcacgaaattgaggcgtttaatgaccggattagtctcgacgatgtccgtgatatttatatgccgtttgcgcatttgttgcaggccaagtatgaacactacttgtcatggcgggaaacggagtccgtttttttacaccgtcagaaccgccaatcaccctttattattggagtgtctggaagtgtggcagttggcaagaccaccacagcacggttattagagattctatttaaatatttatatccagaccggcggacgcaattgattacgacggatggtttcttatacccgaatgccgagctcaaaaagatgcaattgatggaacgcaaagggtttccggaaagctatgatatgacgcggctgatccaattcttgaacgatgtgaagagcggaaagccgttagcgaaggccccggtatactctcatcagacttatgatattgtgccaaaccgttttgacgtgatcacgcatcctgatattttgattattgaaggaatcaacgtgttgcaattgccaagcaatcaggcgatctacattagtgattttacggacttctcagtgtatgtggatgcggatgccgatttaattgaagattggtacttagaacgcttcaaggccctgatgaaaacggctttccaggatccgacgaattatttctatccttgggcgatcggtgatccgaaggacgcaatggcgatggccgagcgtgtttgggaagaggttaacttgaaaaacttgaatgattatatcttgccaacccgtaatcgtgcggatttaattttgcacaaagttgcgcatcatgtgattgatgccgtgtatttccgcaaatattagcacctaagaaatttctcatactggttgaccgaacgtttagaaatcagtatgatagacctattgagcattaattaatccaaaggagtgaacaacttggcaaaaacggataccgcgtctttcgattccattttggtattggatttcggtagtcagtataatcaattgattacccggcgcattcgtgatttcggcgtttattcggaactacttccgaacacgatcaccgctgaagaaatcaaggcccgtcacccgaaaggtattatcttttctggtggccccaacagtgtttacgatgatggcgcctttcgggttgacccggagatttttaagttgggcttaccaatcttggggatttgttacggcatgcaactgatgacctacacgcttgcgggcgggaaggtcgaatcagctgataaccgtgaatacggcaaggcgaacattgacgtgacgagtgactcggcgaccctatttaagaacacgccagctgagcagtcagtgtggatgagtcatggtgacttggttactcaggcacctgatggttttgacgtggtggccacttctaagaactgcccgattgcggcaattcaagatgttgaccggaagttatatgggattcaattccatgctgaagttcggaatacggactacggtaatgatattctacggcactttgcatttgacgtttgccaagctgaagctaactggtcaatggatgatttcattgatatgcagattgaaaagatccgcgctgaagttggcgacaaaaaggtcttactgggactttccggtggggttgattccagtgtcgtcggtgtgttattgcacaaggccattggcacgcaattaaccagtattttcgttgaccatggtttgttacggaagggcgaagctgatcaagttatggcgagcctagaaggtaagttcggcttgaacatcatcaaagttgatgctaaggaccgcttcttaagcaagttggctggtgtcagtgatcctgaacggaaacgtaagattattggtaacgaatttatccaagtgtttgatgaagaagccacgaagttaaacgggatggaattcctcgcacaggggaccctctacaccgatgtgattgaaagtgggacttcaacggcccaaacaatcaagtcacatcataatgttggtggtttgccagaagacatgcagttcaagttgattgaaccgctacggacgttatttaaggacgaagcacgggaactcggtgaaaagctaggaatgccgtctgaccttgtttggcgtcaaccattccccggccctggtctcggaattcgggttattggtgagattacggaagataagttagaaattgtgcgcgatagtgactttatcttacgtgatgaaatcaaaaaagccggcttggaccgtgaaatctggcaatacttcaccgtattaccaggcatcaagtcagtcggtgtcatgggtgacggccggacctacgattacaccgttggtattcgggccgtgacatcaatcgacggtatgaccgccgactttgcacgtattccatgggatgtcttacaaaagatctcagtgcggatcgtcaatgaagtcgatcacgttaaccgcatcgtgtacgatgttacgagtaagccaccttcgacaattgaatgggaatagaaaatcatataaaaatgaaatcgtaatattgatttaacagtatttgtgagcttataaaatggatgaattggtggcgaatctgaaagatttcctatcaacagtctcactaagaatcgtggaggtctttagtcacttaggagtgattaaggatttgcacgattctttttttattggattcttgtttgttcacaaaacattgcggataatgtaagtaagtagagatatatcatatagagtgtggaagaactgttatggcaattacagaagtttaagactaaatctaattgataattgatgaaccaaatcacaaagagtttgttagcacttttgaagagtgaatcaaagagaacccagaaaataatttctaagttatgaaagtggtaatgatttttacaaagaattgaatgaagcttattaaaaaacaaacttttatttaagcgtactaattcagatttaatgcaggcgtaatatcgatggtgtaataggattatgaatggtttgttttcagaagttagtgcaatcaaggttaaattctgagtgataattttattttttatcattagtaggacattttttagtaggacattttttgacatttgtgactagtgatattgcagtgcacgatacaaaggtgatagtgtagttagtatagaatagtgagtgaaaaggagtgaggaggggtcatgagtaattatctagtgggtcctgataagaaaaatctgtttggtcggcggtcaacgtgggattttgatcaggcaattgaagcgtccagtgatggagatgtcattgagattgaggcgggatttgatccgttcaacggtcaaaataaccaatctatagttattactaaaagtattacaattcagggtcacgttgaaaatagagagaatgaacatatctataccaatacaatcgatggtattgtagtgaaggatggagctacagtaacgttgcaaaatatttgtattcagaaaaatactgataagagtaatgcaattactgtgcgtatgggttcaactgtaattgctgaagatgtttacttaattaacaaatcaacgactggaacaaactatccaattgtgtatattagtggaaattcacatgtacaattaaagaatgtaacagtcggagctagcaaaatttcagatggaaagcatcgtatttacgtcgagaattctgagctgactattcgtaattcatggatttgtgcaaaggtgtatttgaagcatgctcaatttttatgtcataaaagtcaactagaatacacggacggttgtgtgcttaacggaaatgaacaaagtactatccaattaatatcgtcaactttaacgggtggaaaaattctgtctaaagaagtgtatccatgcgttcatatatgtgattccaaattaacctgtcaagattgttctattaatcagcccaagtttgacatggctctattggtgttaaacagtcaaatgacacttaaaggtggtcaagtggattcagttagtttagatcacaccacggctaatattaacgaaacactgattcgggaaagctttgcaatcgaaaatggaacacaagtcactggaaatcgcttttttattctagggcgtgacaacggcaaagtaaatttgtatattgcgggccgctctaatattcaggtctgccatattatttttggacaaatctcaaatccaaatttgaaacttgaacggaatgtagatatcggtaagacagcattagattactaccaatataatttaaacaatgggacgtttgtggtggatcaaacaaatcattacatttccgcggacaagcagggtcaagtgagttattttggtaaaaagcctgcgttggatcgtctcaatgaaatgatagggattagtggagttaaatcggagattaatgaatttattgctatagcccaaatgaataagcagcgtaaggagcaagggataagtagtgatgccatgacactacattcactattcctaggtaatccggggacaggaaaaacaaccgttgcacgtattttaggtgaaattttatttgacaaaggaatcattaacgatcagaaatttgtcgaggtttcacgttcggacattgtaggacgttatattggcgaaactgcgataaaaactcgtaaagttctagagtctgctcttggcggagtcctatttattgatgaggcatatacgctagctaacggggatgagaaagactttggacgggaagccatcgatgagattttaaaattcatagaggatcatcgtgcggatgttgttgttattttcgctgggtataccgatcgtatggaaaagttcttaaaaatgaatgagggactgcgaagccggattcctaatcactttatgtttgaagattatacaccccaggaattaattgaaattggctggaatgacttaaaggctaaaaattatattgtggataaaactgcatacacggacttagttatgcataattttaatgtctctcacgatcatagtaatggccgctgggttcgtaatcttaatgaaaggttaatcaggaaatttgctgttcgtgtcgccggccagcaaggagaagacctttctgcaattaagcagcaggatattgatgctgcaatgttatagtgacaacagaggagtagtgaagaatgacagaaaagaaacagtatgttcggccgcccaagccagtaaagataaagcctacggtatctaggaaaaaacttagccataaattagacgcatataattatttacatcccgattattggaagcgaaagttagctcacttattactagtaataccagttgtgtggaccatttatggtatgattctactggccatcttttatccaggtatgcaatcaggaattggagttactgttagcttattaggagtaacgatgagtgtattgcatattgttctgacggcaataagtgcttatttctatccatttagtttgtactggtatcgtgaaagtttgataggacgcattttaaatggcatgtggtactttggtggcttctgggctgttattggaaaaattattgtcacactgattggtggcattttgattgcaggtcttttgacaccgattgctggaccaataacattacgtcgttgccgacgaaaaaatataatcattggtgacgcaaaagattttgaatagaatattattaataataagtaagtggatctagaacctgttgcagtgctatgatccctttatggttgtcagatgaaataatataattcatctgacaaccatggagggattttttatatgccaaggtctagacatacaccggccgaaaaattggctttaattactgattttcagagctctggcctttctattagcgcatttagcaagcaacatgaattgagttgttattccattagataatgggatgttatgctatcaacgtgacggtattgatggactagcagaggccactaagaatcagcactacagtcagactttcaagcagaagatcattcgagcatatttgaatggagagggaacaattcaaggattaactaataaatatggattacgttcaacttcacagctaagaaactggccaatcaagtataatagggacaaactgtgacggcttcaccgtctagaaagcaggtcctaaaatgagccgtaaaacgacttttaatgagcgagtaacgattttggaatggattaataaaggtaatcattcatacagtgaggccgccgaacatttcaacgtttcttatcagcaagcccgttattgggccttaaaggaccaagctaaaggttttgaagttttggtcgataaccgaggacatcgtaaacccgaatcagaattaaccgatttggacaaagccaatctgtggattagacaattagaatcacaaagcaaggatcagcagttattagaggctttcataaaaaaatatcaggaactttagcgcaagggtgaattcacaacgtcgactggcttaccacgcaatcaaggaagttagtcaaaataatcacggtacggtcactaagttattatcaatactcaaagttagccgccaggcatatataaggggctccatcgtgacgtaacgacttgggaaattcgagataacttcttaactgaacgggttcaatactggtataaccaacatcatcaaagtattggcagctatctaatctcagaaaagacccgaccgttaccgaacaggtgacgttaaagcaagttaagcgaattatgatcaagcttggaattcgttgccaggttcgtcagaaaaagcattcacggatcaaacaacaggagcaatacttacaagataatgttttaaatcagcattttagcgttaaccaaccaaatcaggtctggttggccgattcaactgaattaatttatggtgttaatggtcagtataaagtacgcctgagtggctactgggtctttgcggtcggcatctaattgcccataaactaagtgaaactgaaactacgaatgcggaagttcaggtttttcaacgggcctttaattttgcgggtgacgtccaccctgtagtgcatactgaccgaggttcggcatacatatcaggagtattcaataatttttggcgcaacatgaggtactcgtagcatgtcacgaccaggaacgccatatgataacgcaccaatggaacgatttcaaattacgttggatggaccgacatgccaaaccagctacctataaagaattagtggccttggttgaagaaggcagcaactactttaatcagctagaccgttcatcagcaagaaacgacctcaccccagcggaatactggaatgaggccgtttaagtagagcaaaacttatattatttcaaatgacaacttgacagatactcgtacagtaggaactccaatgaaagaggttttcgtcttggtgtttttattttgtaaaaatactagtggctaacttgattttaaaactcaccatcaatgttccgtctcatttcaatgaattttttatatctaggatattgaatgtgatgaaaatctagctcaggcataatattgattagggaactgtcgtgaaaatgcgtgttattcaatagccattctatctttctgtaacattcagcaactacttcatcattactacattccataaaaatcactgaagtgacaaaaatatcgtcaatattatcttcagtttttttcaaattaaagaaataacgctttaatgaattagcaagatcatctagattgagttttttgggattttcaatatagctgaggtaaatatttgcccaggtgattccagtttcgtttcctattgaggattctaaagtatcaaacgtaacctgtttgaaggtctcaggttccttcataaacttctgtattgtcttaatgggaggcttcaagagtgctttagaaacttctgtatagtcagagttccaagtacttatttcaaaaaagtttccaatcaatctttttactagagaacgtagcacgtcaaattcagatacgttttgagaaatgttaaaaaatggagtcagcggccaccggaatattggctgaaataaaaatctgccgtgtgcaatcgcatttctaagtttaattactgattcaacgaaatacatatcattttctgaatctataccattttttgatagtaaatggtagattgcaaatttnnnnnnnnnnttttacaatctaccaaatattttatttttgtgctaaagttagggctctttgcgcctagagctgttgatacaatcttatatttatcgttaacatagttatcaagttcgtcattccttgttagcataagtgaagcatattctttcaaacttgactttattttgctttccgcaattttctttaattcatcttcgcggctgttactcaatagttctaaaatttgaaagagtccaagtaaagcttcatcacgatataaattgctttctaaatcctcattctctaggttgagatttttgcgccatcggtcgagtagagaaatagaaaggtttttatactttgaatcattgattttaaataatactttttctaaatcttttgaatagtcattcatttcggtttgaaaaatagtttttgggggattgtcgataccatttttaaccacgaaagaggatcctgattcagtaatgtcataaatagtgatgggacattcaagaaatagagaaattatcccttgaatgacaagtaaccatggtctcattagtcttgaagtttctacttgtgaataaattgggtctatattcaattcaccacgaactgcaattacagtgcttttatcacgactaattgattcaactgttataccattgaagctaaaatatattttgatattacttaaatcgtaagtattactgtcgacagagtgaactgtaaaaaagtgagttttcaaaatgttttcatcttctctcaagttttagtaagcatacatttttcttgcttttatacatacatcatatcaataaaaattttatttaaaattttttcaagcattgtcagaatttatgatagttgaaggattgattcagcttaaacgctggctgacaagtgtacttatcggcatttatcgcaagtatgtcaaatcagaattaaatagcatatcgaatccatccggtaaggatagttattctatattcatcagttaacgttccacgggcgtttctaagagcagtagcgataaacccggtgatagtagtcgctatgaactttgaagtgttaacaaattgttggtaactttgttagccaacgggcattcgaatgtcagtattgagaaatgtgtgcatagcactgagtaaatttggtttgctttgcaattgcaaaagacttgtcagaattcgttaattgtaacggccttttataaatggtttgcacaattggaacgtacgttctttttgggcctgaataaaagcccagttaagggctgatattactaactgattgcagattagactatgcttgtggttgactaaaatgctttaatgaagctaaatataaagatccaccaataattgcgagaattccgccaatccaacccaagaatggaataagcgcgattgcgccgccgacaattagtaaaacgcctgatgcagtaccgacacgcttatcacctttataataaattaatgcaataattcctaatgctaaaatagcaattttcaaaatgtttaggaaagcggccgcacctgatgtattagatactgatccagtggcagcatcgctaacaatgccaccagcaataaaccagcccccgaataataaaataatgccgccgactagccctacaatcccgttagtaagtgctaaattttttgacttcatgttgaagctcctccctttattaacagcttttcgtgtcgatcagtttattggacataagttgttgaagcctacccaaaccattaatccccgtattgataggcttatttttcgtataaataaacaaaggtgaccaatattctggccgataaataagctttccataagcgtgcccgaagtaacttggttcgaacattaagatacttcatcgtaaggggcgttagtcgcgtttagccctattcccagaagatgacggccattgctactcgtacttgttggcgttcttcttccgtaagtgcttcgcctccgtatgtcatcgaatccacatgagctgtgagaaagtcttttaagtcagtggtatcttttctagcaatccatttagatgcgctatcttcacccagcaggtagtcggttgtcacatcatatagatctgcaatctgtttaagcatgttcaaatctggctcattcgtgccatattcatagttggcatatcgctgcatactgctcaaccctaatttcctggccacctcagtttttgaccagttccgactgtcacgaaggttaattagtcttcgaatgaagttgttttgtgtttttgctggcatgttatagtctcccaatgaacgtattgtataatatttaaacgtaaaatttatatttttaaataaaaaatttaagaaatagcttatttaaataaactatttaatataaaacatgatttatcgatataaattaatcgcttgttaattataatgcattcaggttgttggaacaaaatagattagtatcaagtgttatctagatgatggttttattcctaggatgctactagatttagatacgatttttctcactttaatatatacggagataatgatttgagaattagtatgatttggaatatcggcagagttctccaaacagataaataattaaaaataggtggttagacttaaaacgatcactgttttccgatgattgtagtttcttaagatagactggtcaaatagtgcaatcataatttcactctgaagaggtgattgttcacaatcaaatggtcttcattatggtattatgacaaggacactagtggatgtttagtcagcttggcggactaatcccaaaacgagctgaaaagctgatgcaaacacataaggaggttggaaaattttgaagtcgaatcgttctattgtcacctggctcctcaatatcgttaaactaattggtctattcgcactatatcaactcgctatgattcctacgatgatgccagcaattcgacacgggttctcggccacggcaacactaattgccggagtggcaagtttagtcttgctcggattactcatttggtggctggtaacgatttatcgtcgtcaagcgccaatcgtgaccagtttatcacgaccgacacgtccggtgttaacgatagtgggcctatttatcctggttgagttaggtaacgtgttggcgggacttatcgtgaaacaaccccctgaaaaccaagtgattttggataaggtatttactactagtccagtcattaatgttgtcatgatggcagtactggcaccgattgtcgaagaactgatttttcgtgggctgatgtatcgttggttatttccgcgggtcacaaattgggtgagtttcacggttgcattagtttttgcgagtttagtatttgcccttgcccatacgttatcatttagccctgcgctactagcctacttaccgatcgccgtcgtgctgacttttacgtacgtgtggttcaacgatattcgctatagtgtcgccttgcacattatcaataattcattagccatggttggcatgttgactttgctttcacgttaacacaggttatcctaccgacatagcggttgacattcgcgtattagtcgcgtgatgtgtaatgattaaaacaggcaacgtccaaattttgggcgctgcctgttttattaatagcggtgtggttgatgtagtggtaatcattgtttggtcacttaataatattaaacagttcagttataccaagaatattattatgatacaattttcgatggaggtggcgagatgcgtacaattacaccaattgagaacagtcggcgacatgaagaattttgtccattggatacaaccttgagtatcttgtcgggtaaatggaaatcaattattatctgtcgattaatggggagttcgcagcgcttttcgtccttattaaaaggcatgccgggctgtaccagtcgaatgttggcgatgcaactaaaggaattagttgcggatcagattgtgagtcaacaaacggtcgctaatcattcagtttatgagttaacgaacattggagtatcactagttccaatcgttaaagcaatggatcgatgggggaaggcttaccttgaaacgttacagttggcgtagtcgattggtcaatgcttagactaagtataggacgtcattattagccactatttttaacaatcataaaaactgctcgcaggaatcttggggatatactcctctttgggtagacaagcaaataatcaaagcttgcctacctaaggaggagtttttctatgggcagaaaaggttctcgctatacgattaaagagaagttgttttacattggtctagttactcagggaatggctcctaatgccgttcaaagaaaatatggagttgaacatagtcaagtaagccgatgggtaaagcgttatggattacaggggatcgatggcctgcggcatcgactcatgggaaagtatccaagtgaattgaaattaaaaatagttctggagtacctagaaggacacagttcttatcctctattatgcgataaatataatattcctaacgttagtactatctatcaatgggttcatcagtatactagtggtaaacaactcaccactaggagtgtgaaacaagtgaaagatggtcggaaaacaacccagctggaacgtgtagaaattgttcaatggattatagcaaacgatatggattactcacgcgccatgaataagtacaacgtgtcatatggtcaggtttactcgtggactcggaagtttaaacaaggtggaccagaagcccttgtcgatcgtcgtggtaagggaaagactgtgcatgaccagcttacagataacgagaagcgtgacctggaggtcaagcgtctaaaggcccgaattgaacatttatcgacagagaatgcagttctaaaaaaactccaagaattggaaaggttggatgccactcatcacacatctacgaaacaatccaaactttagcaactacggtgaaccctgatacaaaccaagtttatgggattagttttatgtgtcgttttatgaaagtctcacgtgctgcatattacaaatggatacaccgaaccccaagcaaacgtgctctggaagataaagagatattaaagtacgtcaaaattattgaagaggagaacgaatatacccttggagtacgaagattaatgatgaatcttcattgcgatacaacatatcgaactagtgctggaaaaatgcgccggatcatgcgtgaaaatggtatcgtggcttcaattcgcgtggcacagcatgatcgaaaagctcaacggaaagagcacatcagcaataacctcctcctttcagatgaaggccataattttaagccagacaagccaaatcaggtctgggtaactgattgtacagagctacgttttggttggaaattcagtgaacgtttgagacttagtgcgattaaagacctgaacgaccacagtatcattgcttgggacattgaagaaactgagacagccgatttggtgactcgaacatttgataaggcattagcaataagcaatggtgcaaaaccaacggttttacactcagatcagggatcaagctatacatctggagtatttaacaaacatctagctagcaatggggttaagcatagtatgtcgcgtccaggaacccctggagataacagtcctatggaaagcttctggagtcatatgaagaccgagttctttaattttcaccatgcattaaatcgagaagaaatggttcaacttatcgaaaaatgtattaactggtataactacaagcgtcgccaagaaacactaaatggcatgaccccgaaagaatttcggaatcatgccattctaaaaactgcatagctattttaattattttaattatttgaactgtctacttgactcggagcagttttttaatacgcattaaaagctgattgtctcaaagctaatccgaatagtggctaagtgcatttgtaatcaatactgcgcctaataaggccatggccgctgcaatcgtcactgcgtaaaagccaattttagttaaaagcaggccaccagcggcagatcctaacgttaagccatagtataaaaaagcactattaaatgacatgatggttgaacgattagatggcacaatattaacgattgttgcagttaatgcagtgacaccccagccttgagataaggcgagcacaatcagaataatcagcaatactgctaaatgttgtccccagatgcctaaggataagactaatgtagctgaaactaagccattaattgtaacgctctgttttttaccaagcaatgatataagtttaccggcaaagaaactcgcaacaaaattagcacttccataagtgataaagatgagaccagtttgtattgtgttgaaatgaaaggtcgcagttgcaaaaacacctaagaaggtataaacgccatagaacccagtcatccaagttaatgtaatcagtagggcagcgatggcgtgaggagtgtggactaatgtcttaaaacttgtaaaataaccgtcaggctgggcattctgactcggtaatgaaggtatggcaatggtcaaaatcgataatgcaatcaaggttagcatggctgaaccccagaaggccatatgccaactactgagttgtgctagtaaagcaccgagtggtacaccggtagcaattgataatgaaagtgacgacataacgatgcccatgacttggttaagtcgttgaccattgaagtaagtaccgataaaagcccaaatgtttgggataaataaagctgcaccgatgccagcgatggcacggtaaagatagaatgttagcaatgagtttgctaatccacagagtagtgttcctagtaagaagatgccacagccactgattagcaaaaaacgtttattaaagcggtcacctaatgggccgaataaaggtgcaccgatggcataacatagtgcgtaaacggtgactccgtatgccgcggtgttagtcggcacatgcagactagtagcgatagcggggagtagtgctgaaataataaatgcgtcagcaccagtcacaaaagccccacagaaaaggccaataataagccaattttcagtatgttggttatggatagtgatttgattgaaaataggactcactccttttgaattaggtacaactaggagtttaagggccttacaatagagaaacaagtgaataaaagtataccagcgactgtcgttaatcggatagaaatataccaccctagtttcgtttgtttttgaaaacagtggctattaatgataactaggtaatgtttgattagcaattgttgattatcaaaataactttatactgtaaaattggaacaatggtacttcctgatttgcgacttcttcaacgactaaaattcataatagtcctgattaaataaggctttccaatgttcaatcaggacataagggtgtaaacaccatctagcattatggcatcattggtttataatgatatttatattagcttattggagtgagtttatggtagattgcaaatttaannnnnnnnnnattttacaatctaccttatgaataagaaattattgtataccagtattaccactgcggcattattcgtggggacccaattgggtgttaacaatgcgcaggccgacacggcaactgataacagcgatacgacgaatcagacgagtgccacgcaggggagcgctcagacggcaactaacgaaaagttagcaacggtcaaaccgactagtcagcaacagtatcaagccaacgtgcagactgccaaggggaacgtagtcacggctcaaaaccaagtcaatacaacacaagctaaagtggcgactgcgcaggggcaagtgactaatcaaagtcaattagttgcgattggacagtcccagtatgatgctggtaaagcccgagttgaccgtgcacaacaaaaactggatgctaacaatcaggtcctcgctgaggctgagaataaagtcgacgctgctaagtcgcaaacggcagcagctgaaacgcaaattccagctgatcaacagcaaattgcggccaacaaagtcgctatcgccaaccagccagctaccgagaagaaagcacaaacggctaaggacgcggctgacacggccttgacgcaagctaaaactgaacaggccacggcccaatctgatgccgatgcagccagtgccgtcactgccgctaaacaggcgacggttgaccaagcatctgccgcccagcaaaaagcggccacccaagcaaatcaagctaaagtggccgtagcatcagcgcaagatgcggttaataaaaatacccaggcaatcaattctgccaagacagcgattcaaaatacgaccagtcaaattaatgcgaataatcaagctgtttccacagcgcaagccaaagtgaccgcagctcaagcagctttagcggcagcagaacggccaacgaccacgacggaatcgcaaaataagtatgacgctgccgaattcccacaatctcaattgactggggccgaaacagtcagcgtcgcctatccaagtaatggcaagtatgtgcctaatgcggataaaatcaatcagtatatgtttgaatatatcaatcagctacgggcgctgaatggtcaaccagcattgaaacagacggcgacgttgcaaaataatgcgattgcgcgagcagctgcccaagacgacggtggcttggatcatactggctcaagttatgcagaaaatttaacacaagtttatccgcaatggttcatgagcgatcaagaaacggcctataatgctgtgatgggttggtatgatgaatccaataacattgagtccggttcctttggtcaccgcgtcaacctaatatactcgactggtgatgccggagtagccatcaacttggccaaacacgtggcggcatttgaagtcgataatgccgggatgacggaagcacagcaagacaagtatgttgatttgttcgacaatgcccatgcgaatgccgctactgggactaaggccttaccagctgtcacgttcaattacgtccagacggcccccgctgatccgaagaagattgcggcggctaacgcaacgttgattgctgcaacggctagtttgaatggtttacaaaataccgggaagacattagcaaccacgctggctaaccaaaatgccagtttacaagctttacaaaaccagacaagtggcttacaagcgactgttacgactaaacaggcccaagttcaagtcgctgcaactagtttgacagcggctaatgttgctttgacgcaagctcaagggcaattagcaatggcgcaacagcaacaactatcgcccgttcgtaatttgaagacagcaatcgcgaagacggctgcggcgcaagtaactaccacgcaagccgctaaaaacttagccagtgccaagacattggtagccgatttgaccgctgaaaacgcccgattggcggccgaaatcgcggccctgcccgcgcggattgcaagcatgaaggcccaaattgctacggctgaacaacaaatcgctgttgccaaggccatgctcgcgcaggggcaggctcaagtcgatacagcaaacgatcggcttgctgccgggaaagcgcagctagatcgtaaggtagattgtaaaattaannnnnnnnnnttaaatttgcaatctaccgtaaaaaggccgatttagcacaacttaaacaagtgcttggcgctgccagagttgatttcgccgtcgcacaaggagatttaacggctgctaaagccttcttggcacgcgtcgaagctaacaaatttacaacgacgacggctgtggctgatggaattgttgaaaccacaagtgttgctcaatcggctggtgttactgcaccacatgcaaccgcgactgaaaccgtagcgaatagcaaagataccgctaatgccacgagtactagcgcagatgtttcagatggcaatgcaacaatgaagctggttgcgggcgccaaacaacagccagctgccgcaaaggccacggcgttaccacaaacggatgaaaaacagtcagcgagtttgactgtggtgggattactagcggcagggttctcattattgggtttaacaaagttacgcaaacgcgcttaatttctgagctcaaagctttttagaattattgatcatatgaaataataaaaacagttggattaggatagccgatggataccgggaatgatagataggcaatgaatgcttacctatggttgtcaatcagccgaaatccttggcctgactgtttttttagtggttagatattaagtttagtgaattaaacataaccggtattaacaataaaagacaactcatttttgatattttgtacacggcaaggctaatatttagtaatatattaagtaatacggccattgaagtttttttgattatttaaataaacgaattaaattaatggataattaacggaatgaaaaatgatccgttattaaatgcagagttgcaattgacagccatggtacataatgtgtccgtataatcccgtggatgattgggaaatccagggtggctaactgccgattgctttaaggggaattaaggttgtgaaaggaatagaggtatgggaaaaatcagtagcagaatggtctttgaaattatcacgattatcggtattgtcacttttgccgttatcagtctagcaccatcaacggcgaagcagcaaagtgtgcaattggatcacggacggatgagctacagcggagccgttttgaagcacaagtttgacggtcagggtacgttgcaggttaacaaacaggggcgctacgtgggtaattttaccaatggccggtttgaaggcccaggcgaattcattgcaccgaacgggtggcgtttgcaaggcaacttcagcaagggtgcgttgaatggtgtggtcaaactgcgggtcggcaacaagacttatgccaaaaaaattacgggggacgataagttagaaaatgcggattaaatggtttagtttagtacggataacgggactcgtgctggtattgacgtatcactttttccaaacccagtttactggtggctttatcggggtggacatcttctttaccttctcagggtttttgattacgtcattaatggtggacgagtttgctcgttcggataactttaaactaatggctttctatggtcgccggttttatcgaattgtgccaccattatttattgcggtgttattggtgctaccgctaacttacttgattgaccacgattttgtgaccgacattggtaagcaggtcgcggcggctctcggatttacgactaattattttgaaattgcgacgggtggcagttatgaaaacaagtttattccgcacttatttgtccatacgtggtcattagcggttgaaatgcacttttatattttatggggcctgattgcgtggttggtcgctaaaatcagtcggcggttggcgagtggtcggcgcgcattgacccgttttcgctggggcttagggctgttgaccactgcctttgcgattgaaagctttgtcatgatgtactttggtgcggtcggcttaaaggacttttcaccagtctacttttcaagtctgacccactgttttccgttctttgtcggcgggcttatcggtgtcctgagcggcatcaaggctcaagggccaatctatcgttggaccacggcgcactgcaatccgatcattgcgggcgcggtgatgcttattagttttatcttgttagttgctttaggcgaccggatgaagttcgatgcgctacaaacgtatcaggatgggctgttactggctactgtactcgctggcatcatgatctatggcgcccggttgttgcatgaccacacgccgaacctcaaggaaccgcggtggatgacgttcttagcggatgtgagctatagcgtgtatctctatcactggccgttgtacgtgattttttcacacatgatggtcaactggttggcggcactgctcacgacggtactgtcgattatcttatccgcgctgtcatactacgtgttagaaccagtaattgcgggcaaacgcgcccacgttttcggtcatacagtgacgtggcgacagttgcagttacccgttatcaccgcaggagtattgttggcagttaataccggggtcgtagtcaaaaatgcaccgcaactttcgacactggaacagaatttatgggtgagcgggatttaccaagatattgataaaatcggaacgactcatgaagctgtgctcgcggccgtaacgcccaagaagaagcaggcaacgcctaaaggtgaccaagaaaaagcaccaggtgtttccattattggtgacagtgtcacgctggggacgcggagctacctgggcgatcacgtcgcgaacagcaatattgatgcggagggcgatcggacgatgaacctggcatataaagtcatgatgaaccagcagcgaagccatacgttacggcagtacgtggtgatttgtattgggaccaacgcgctggatgattacgaagaacaaaccatgaagatcattcatgacttggagccggggcacaagttgattctgatgacaccttataatgcccgggccgatgctgactggaattcatcaaagttggccgttttggaacggcgtctgccagctaagtataagttcattacggttgccgactggggcaagattgcggcgcaacatccagaagttttcaaagggacggatggcgtacacttcggtggcattcgggctggtgatattttatacgccaaggtaatcaatcaagcattgacggcagccaaacagactccggctaaaccagcctaatctagctaagtcagagcagttattagtagtcaatttaatagaaataatcagcttgcgatgtaacaattggcaggctgatttttttatgtttgtggttaaattgcgaagcggcgggattcgttgatggtaattgttcagattttaagtgacaattcgaccagtgtgcatattaattgtcccaaaatcaaattatggttatcataagcatgtactcaaatataactgtaaggagtgattagaatgttaggatggctatggtcattaattgttggtggtgtcattggtgcgttagcaggtgcgattaccagccgtgacgttccaatggggatcattggcaatattattgccggtttagttggtgcctggattggtcaagcattgcttggaacttggggaccttcgttagctggtatggcattggtaccctcaatcttaggcgctattatcttagtattaatcgtttctgcaatcttcggcatgcgtaagaaacgttaggcggtgattagatgagccgcttagctaagtttacggtgacgttagtcggaattgtattggtgttattagcggtttttgaactgggtcagttgtacccgatcccgtggttgacgtcctggttagctgatctgacgattaactacccaatggtttggagtatcttattgatggtctttgccattattgccggaatcgttggtatcttattgataattgttggcttgtttcgaccagttaaagtcagcacgttgacgtatgatggcaaggttggccagttaacgattccgcaacgggctttggaacgtgatttgcagtaccgactcgttaatcagttgaatctgattgatcctgaggttcacttgaaattacggcgtcgtcgccgggtacgagtaaaaattgatgcgatggttaatactgacgcatcgttagaaaccacggcccaacaggcggcaaccttggcacaggactatttgaagaatcaattgggattgacggtcgaacaaccagtagtgcaagttaagccagcaaatcaccagcgtaagttaaccgtggtgtaaaggagggtcctgatgagtaacgcacagtatggttttctgattggactgcttttaggtatcgtctgggtattaaccagtttttcggcagtcttattagtcgcagttttagggctgatcggctgggcgattggacggtttgtccacgtcgatttggctgcagttagtcagaagttgagtgagtatttatctaaataatgggaggaattacaatggcacaaccagaacaacaattacagactcaattgacgtttgatgacggtgtgattgaaaaaatcgccggtctagcttcacgcaatgttgacggcgtgttatccctagaaggcggcatgttaagcaatttaacgaaccgctttcgtgatgaagctgacccgacgcagggggttgacgcccaagttggtaagaaacaagttgctttagatatgacgatgatcgttgaatatggtaaggacatgcgacaaatcttcaatcaaatttgtcaacgtgttcagcaagatgttgaacggtatactggcttgaaggtcattgaaattaaggtacatgtcagtgacgtcatgagcaagcgtgattggcaagatcaggccactggcaaaccaaatacggatcaatcaacagataagcggcaagttgaatagcacggtcgtttagagtagtcattggtaagacgatttttgacaaaacaaggaggaattttgatggaagcaacagcgacatctttaaaaccagaagttgtttttgacgatacggtattggcaaagattgctagtaacacggcccaagaagttgaaggagtattgagcttacagggaaatctgattgatgatatttccaatcgctttacggataaggatcgcccgcagaccggtgtttcagtggataccgatgacgatgaccagacggttggaatcgaattgacggccattctagcttatggtaagaatggtcaggagattctagcacgggtggcggataaggttgccaaggccgttaaatcaatgactggttatcaagtgactaagttaaaattagtcgttaaagacatgttaacgacagaagagtggcggcaacaaaatgacaagcaagaaaaagcaccagaaaagaaacatccagaaccaaaggatgacggcccacattaatggcagccgtaatggttaaaggtactcgcaaattaggcgggtaccttttttagtgatgagcgttacatgaagaagtatcctgaactaagttcgtaattgcgtttgaacgttcatgaagattgtccggaatgaccgtcacgcaactatcattattgttatgattcatgagatgagtgtacaataatattaatgaggtgattaatatgaaaattggcatgcgggccaaccgaccgtttatcattacggatgaacagcatggacaaacagttttaaatgcgaagacagttttggaagcgctacatatgccagcagcggaccggcaacttggctcgcttgaaacgtttgcgccgcaagaattagcggcaccaatcacggccccgcgacagatttttgcggtggggatgaactaccgcgaccattcggcggagatccacattacgctgccgaaggttccaagtatttttacgaagtttagtagttcactggcaccagcgaacgtgaccgtggcgacacatggtcctgagaccgactgggaaaccgagctagtcgtgatgattggcaagggtgggcgcgatatcgcgacggctgatgcaatggcgcacgtggccggagtgatggttggtgaagacttatctgatcgagccgttcagttcgagaatgataatccacagttttcaataggtaaatcgtttgaaaattacgcaccagttgggccgtggttaacgaccgtcgatgagttagctaacttagacgatgaggtgatcacgaccaccgtcaatggtcagacgatgcagcaagcgccgttgagccaactgatcttcaaggtaccggatttggtgcactacttgtcgacggtctgtgagttacaaccaggtgatttgatttttaccgggacgcctagtgggaccggcgttggtcgcaatccccaagtctttttgcaagccggcgatcaactgtgcggtcagattacacatttagggacgttaaatatcacgattaagtaaatagccatagtcggtaagtgagatgggtgaagatttatattgtaacgcccagcacaatgccgactttttttggtaccataaaagtaattattgaatagggggataccggtacgggaccggtgaggagcaacatgaaaaaagtgtgggtcggattattattaggaagtttattattagcgggatgcacgacgtcgcccaagtcgtcagcgcccaagacgagtcaaaaagcaacgtcaaccaaggtagcggcaaagcaggctgctagccaaaaaagtaccgctagcagtgattcttcatcaccggctgaggcaaccttgtggaatacgggcaagcaagcggctttatcaacgtttatggccgcttggcaacgcgagatgggccagacctatgtcgggacgtatgatgacaaggttcctgaccatttaggttttcgttttcccaatgctttgcttaatggtagcttagcaggccgaatcaagtggggctcgcagtcagtggatctcaagtggtccaaggacggcgaagaccgtagtgaatttcaagtggtggccgtcgcaacgggtggtaaggcggaagcacaatatccaaacacgtacttcttttgcctccatcatcggcgaccagtcgtctttgtgactcagacgaccaacggggacgagttgatcattcatgacacgcagaacagtgctttgcaagccggctttgccaagatcattacgggcagtcgaccgacgacgctgacagatagtgcgctgaacgtgaacatgagtcgtgatgcgaaggctaatcaatggcctcaaagttatcaggggacttggtattactataataagtacgatcacaagattaattcgatgacgcaaaatgataccgacgggttgaagctatcttatgtggcagctgagggacaaaaatggattcatattatgggggccgagcagactgctggggccggtaactttgaatacgtgcgttatcattattttgatggccgccaaattccagtcttaatgaatgctagtggtgctggggcctggttcgataataacgcctatccttcagcagccgcggcaaatcaaatgcgtgactggcaatatggagatgaatcaaagaccagtccggccgctgactcattagattaatcgagggtgtcatgatcggtagtgcgggcagggataaattaatcactgtgaaaatataatattaatataaaagccgggacaaatgcacgtaaattgccccggttttcattttgtaaagtttatgtatatattgaaaaagtcggaattgttttctaaaaataatgctatactatgacataagttaacggtgtcaagacatctaacggccggcgcattcatgtgaacggcacgacattttaaagctgattgtcgatcatgattgctgtcatttgggggaatggcgcgatgatgaagattaccgtcaacacaagtgtgtacgattggtcaaagagtaggaaatacaaagaaaaaaggtgtagacatgcagaaaaatacggaacacacgctcaaccttacgatgacgatgattttgaaaatcggcagcgcccggtcaatgattgcggctgccttagccgagattgcggcctatcgctacgaggcggcacgtgaaaaattacgtcaggccgaaactgaattgctaacggcccagcggttacaggtacgccgactgatcgagaatgccaaggctcaacggtttgtgcactcgacactctttatgaatgcccagtcggcattagtcaacgtgatgggcgagttacagatgactgagaatctgattggcgcttttgaacgctgggagccagaagcggcttaatacgaacgttaagctgacgagtgaaaggtcgcgtactggttcatgattagattttggaagatggtattcggtagcaacttagacggatagagatggggttaaaaaatgacagttacttttagtaatgaagatgatcacaagtttcataagcttactgaccaatgttttactgccaatcctaaattactgacaaaggcaaatatatcagtaccactaactacccgtaccattcagccacgccgttatttggtggtcaccaagatcaatcaggctaccttagcgacagctacgtggcaaccagtcaccggtgcaattgcgctacataagcatgaacgtttgatttatgatttgggagcgctatacgtcggccattttcaagttgccattgacgtggccggttcgccaatggacgcgccgttactgatgcggacaaggtttgccgaacagttgcaagagttaagtgtcgatgctagtcgcgtgaccagttggttgcccacagcctggattcaagacgacacgcgccatgttgaattattgccgaccacggtccaattcgaacgccgctatagctgtcgctacatcatgttggagccggtgggtcagtcgctgaagtggcagccggtgttggcggatgcggagtttgaagaaattattgatgactttagacaagcggcgtaatatcgtcgtttacactaatgattatcgatatcgtacggtgcaaggaaccgtgtcatcattagtgatgggggttgtcgagaattagttgctaggcgcgtgacaaattcatgggcggcagaggacgcattccacccgcaattgtcgtataatgaatatattcttaaaaaacgaggagaataatatggcaaccacaactcatttttacgaaacatttcaaccagaacattacgatctttatatcaatattaaccgggcggataagctgatttcggggaagtcaacgattaccggggatgctaaggcgcaggaagtgctgattcatcagaatggtttgaccattgctggtgtccaagccgatggtgcggacgtgccctttactgtggatgatgcgattcaaggaattcgaattgaacttgccaaggccggtcaaacaactttgacgattacgtacagcgccaaattgacggacacgatgatgggtatctacccatcatattacgaagtcaacggtgtgaagaaagaactaatcgggacgcagtttgaaacgaccgcggcccggcaagcctttccgtgtgtcgatgaaccagaagctaaagcgacttttgatcttgccatcaagtacgatgaacatgatggtgaaacaatcttaagcaacatgcccgaagatcatgaagccgatggggtgcattactttgaaaccacggtgcggatgtcgacttacttgattgcgtttgcctttggtgaattacaaggcaagcagacgaagaccaagagtggcgtgaccatcggtgttttcggtactaaggcccacaaggctaacgagctcgactttgctttggacattgctaagcgctcaatcgaattttatgaagatttttatcagacgccatatccattgccacactcatggcaattggccttaccagacttctcagctggtgcgatggaaaactggggcttagttacttatcgggaagcctacttactattagatcctgacaacacggccctcgaaacgaaacaacgggtcgccacggtgattgcccatgaacttgcccatcaatggttcggtgatttggttacgatgaagtggtgggatgacctctggttaaatgaaagtttcgccaacatgatggaatatgtggcgacggatgccttagaaccagactggcatatttgggaaactttccaaacgtccgaagcatcaatggcgcttcaacgggatgccacggatggggttcagtcagtccacgttcaggtggaagatccggccgaaatcgactcgatttttgacggtgcgattgtctacgctaagggtgcgcggatgttagtaatggcgcgggccttagttggtgatgatgccttacgagcaggtttgaagcagtactttatcaatcataaatatggtaatgccaaaggtgatgacttgtggaacgccttagcggatgcttctgggatgcaagttggggacatcatgcattcatggctggaacaacctggctatccagtggtcacggcagcggttgttgacggtcagttgaccttgtcacaacaacagttcttcatcggtgaaggtgaagaagtcggtcgtcaatggcagattccgttgaatagcaactatgaggcggcaccagcgattatgaaggaccaagctgtgacggtcggcgattatgccaaattacgtgatgcgagtgggcaaccattccgcttgaatgttgggaataactcccacttcatcgtcaagtatgaccaaacgttattggatgatattctagcgcatgttgatgacttaacggctattgaccagttacagttgttacaagacttacgcttgttagctgaaggtcgtcaaatctcatacgcagccgttgtgccattattaagccggtttgcagccagccattcaacggtcgttaatgcagcgttgtaccaagttgcgggtaacttacgtaagtttgttacgccagattctgatgaagaaaagcatttacaaacgttatttgaccaattgagtgccgctcaggttaaacggttagggtggttgccacaagctggtgaatctaacgatgatcagttgacgcggccatacgttttgagtgcggctttgtacgccaagaatagtgcggccgtattggctgcccatgaattattcgaaggtaaccgtgataagttagcgaccttaccagccgatgtgcgggtcttcattttacggaatgaagtcaagaactttggtagcaaggacttattcgatagtttattgacggcgtcacggcagacagctgatgctagttacaaggctgacatttgtgacgcattgaccgcaactacggaccccaaattaatcaaacagttagttgtgaagtttgaagatgcggatacgattaagccacaagacttgcgggcctggttccgcggcgtcttggctaatccagctggtgaacaagcagcttgggattggattcgcgacgaatggtcatggttggaagccacggttggtggtgacatggaatttaccacttacatcaccgtcatttcacgggtcttccatacggctgaacgtttagcagaattcaaggcgttctttgaaccaaaaatcaatacgcctggtttaacgcgtgaaattaagatggatacgaaggtaatcgccagtcgcgttgccttagttgaggatgaacgtgatgcggtgaatgcagcggtcgcggaagttgtaaaataagttaatattcgttataaaggtagttcggtgctggacgtttcagcgcgggctacctttttagtttgcaatcaaaccatgtttaatttattgccaatgatttaataattgatagaaataactaacactggcctacagcgtcagttaaatatgatatgatattggtaattatggagagtagacttgattagtattacggctaattaatagtcgtatagatgggaggacctatgatggcaagtggacatcaatctgaggcagaattagaaaatcacctcattcgaaagttacaaagcattggctatcattacgttgaaattcccgatgttgaaacgctaaacacacattttcgtgcggtcttgagtgaacgtaatcaagaacgtttaaagggaacaccactgagtgaccgtgaatttcaggccgtattaaatgatttgattggcgctaagacgcattatcaagttgcccaaattttacgtggttcggttgttcagccaactgggaaaattaatattaaacgtgatgatgatagcagcttatacctagaaatttttaatggaaaacaatttgatcagaatatttttgaagttagccatcaaatgacggttgaaggtcgtcatgagaaccgctatgatgtgctgatcttgatcaacgggatgccaattgcccaaattgagttgaagcggcaaggggttgaatttactcaggcttttaatcaaattattcgctaccgaactgaatcgtacgcacaagcaaaactcatgcgactggttcaggtatttgtcatttccaatggcaatgaaacgcggtattttgcgaatggcgatggtgagttaaattcaaacttcatgttctactggacggatgaacataataattggttgaatgacttggacgcttttacgaccactttcttgagtaaaccacggttacatagtttaatcgcaaaatatacggtgttcgatagtagtgaccataaaatgttattaatgcggccttatcaaatatatgccactgaggcaattattaagcaagctatcgatcacccccatgaaaatggttatgtgtggcacacgacgggttccggtaagacgattacctcctttaaggccagtcagttgttattacaagaaactgatgctgaaaaggttatcttcatgattgaccgtgccgacttggatattcagacggtaaagaattttagtgcctatctgcctgaaacaactgggggccagagtcccttggatcggactgacaatactgctgcattagtcaagcagctgtcctctaatgataatggcttaatcgtgacgaccattcagaagatgaataatgcggtctctaatgatcggtataaagatattctgacaccgtaccatgaccgcaaagtgatcttcattgaagatgaaagccatcgtagccagatgggcgaaatgcgaaaaaacgtgaatcattggtttaagaatgcccaacactttgggttcactggaaccccgatttttcaacagaatatgggacccgatgggcggaccacaaaagatctgtacgagaatcagttgcatcaatacttgattcgtgatgcagttcgtgatggtaacgtgcttggtttttcgattcagtatctgtcgacctttgaggagactgatcatgacattacagacgaacaagtaccaggaattgatacgcaagaggtctatgagtccgaggagcgattgaccaagattgttgagcatatcctgttgaaccatagccacattacaaagaataagcattacaatgcaatctttacggtagcgaatacgcgcatggctttaaagtactatcagttgtttagaaagttggatcctgatcataatttgaaggtcacgacaatctttacgtgggctgccaatgaggacgacaacgaggaacaccaaaaacaggatgatgtcacttcacggatgggattagatcaagtcgtgaaggactataatcaaatgtacggtacggatttttcaacggataaattcaaagattattttgcggatgtttctaagcggatgcgcgatcataatgaccaaacgccgacggataatattgatattttgattgttgtgaacatgttcctaaccgggtttgactccaaacggttgtccacactatacgtggataaaaatttgcaatggcacggtttaatccaagcattttctcgaaccaatcgtgttgagggcaaacaaaaaccattcggaaatattattgcttatcgaaatatcaaaaataagacggatgaggctgtagcgttgttttcagacggggacagttccggcttcttagcaccagattatgatgaattaaaagctgaatttactgacaagattggccaattactgacggtgactccagatgtccagtcagtggacgacctctataaccgaggcgatgacgcactatatgagtttgtgatggcgtttcgggcggtcctccgggtatataatcgtattcgcgtgtatgatgattttgaatgggcgcaatatgaacctgaattttcggatcagctgatggaagcctttcggggcaaatattttacggcttatcaaacgatttaccaacgtaaaacgcaggagcgcgtctcaatattagatgacgttgactttgatatcagtctattggagactgataccatcaatgttgactatattgtgaacttaatctcaggcattgacttaatgtcgtcgaccgaacgtaagcaagatattcagaaaattgaacatttgttggataatgcgaccaatgaccaattaaagtcgaaggttgaattgttggaacaatttttgaatgaagttttgccaacgctcgatacagacgatgatatcggcatgtcgttgagtaactttatggccgagagccagcgagctgccattaagggcttttcacaagaacaccacctttcggaagacttcgttaacgagcagatttctgactacaacttctacggtaagaccaaggacaaagagattattgacaagttaagtgctaatgggctcggctttcgagagaaacggcaggccaaacgcgagattaaggattttgtatcgactatcgaccgaaagtattcactaagctaggagaatgaatttaatgagtcatattgaacaggccgaacaacaggctgaactacaaaaaagattatgggctgtggcaaatgatctgcgcggtaacatggatgccagtgagtatcgaaactatatcttaggattaatcttttatcgctttttgtctgaaaaagttgaaaattacgcaaatgagttacttcaagacgatgatgttgactttgcagatgcggaacaagatgctgacctgatgcaagatttgaaggatgaagtgattgacgtcttaggtttcttcattgaaccacgatatctgtttacaactatggtcaagaagattaacgctggcgattttgacgttgaaatgttacaaaatgccatcaacgaagtccagaattcgaccttaggcaaagagtcagaaaatgactttaaagggctattcgaagacttggatttgcagtcatcacggttaggaaatacagttgccaagcgtagtgaactgattgccaaagtgattctatccttgtcgaatattgattttggtgaacaagatattaaaattgatattttgggtgatgcctacgaatatttgatcggtcaatttgccgcttcggctgggaaaaaggcaggcgaattttatacgccacaacaagtttctaagttattggcaagaattgttacagccggtaaagatcgtttgaagacggtttatgatcctacgatgggctccgggtcgctgttattacaattgggtaattacgcaacgattggaaactactatggtcaagaaatcaacggtacgacttacaacttggcgcggatgaacttgttgatgcatgaggttagttataatcggtttgatttacgtcaaggcgatactttagaggaagatcactttgatgatctaacttttgacgctgtcgttgccaatccaccttattcggctaagtggaatccagatgataaattagatgatgaacgttttcggaaatatgggaagacggcaccgaagtcgaaggcggattttgcgtttgttgagcacatgctctatcacttaaataatgaaggcacgatggcagttgtattaccacatggtgtcttattccgcggtgctgcggaaggaaagatccgacagtacatgattgaacatgacaacgtcttagatgccgtcatcggattaccagcgaacttattctacggaactagtattccgaccgttgtattggtcttcaagaaaggtcgcgaacgtcaggatatcttctttattgacgcgtctaatgattttgaaaagggtaagaaccaaaacaacctaacggacgaaaatgtcgataagattttggaaacccttgaaaaacgtgaagatgtggataagttggttaaggaaatgggcgaagcggatgccaaaatcaacgacctacaatctgaattatccggaatgatggccgacttagtggcgactgaccctgtcgctcaacagcagcttgaggccattaagaggatgttacaatgaaaaacgaaaatttagtgccaaaagtgcggtttaagggctttagtgacccttgggagcagcgtaagctaaagaatatcgccataagagttcggggaaatgacggaagaatggaattaccaactctcacaatttcggctacacaaggatggctgaatcagaaagatcgattttctgaaaatatcgctggaaaagaacaaaaaaactatactttattaaaaaagggacaattgtcatataatcatggaaattctaaaactgcaaagtatggtgcggtattcaagcttgatatctatacagaagcattagttccacgtgtttatcatagctttacagttaaacataataattcggcagatttcattgagtatttgtttgcaacaggaagtccaaatcgtgaattgagaaaattagtttcatctggtgcaagaatggatggattgttaaacattagttttgatgcgtttttcaatattaatttacaagtaccaattgcaactgaacaaatgaaaatagctaagttttttagaaaaacagataaccttatcgctgccaatgaggataaactagaacagttaaaaactctcaaaaagttgatgatgcaaaagattttttctcaggaatggcgcttcaagggattcactgacccatgggagcagcgtaagctttgtcagattgcgaccattaatccgaagtcagttatttctccgcattttctttatgtggatttggaatcagtaagtcaaaatagagtcacacagtataaagcagtgacaaaagatgatgcgccatctagggcacaacgattagcaaaaaaaggcgatatttttttccaaaatgtaagaccatatcaaaaaaataacttgctttttttgacaaacaaaaataacgttgttttttcaacagggtatacacaaattagaaccaagcaagatataagatatctattttatgcattacagactacgccgtttgttaatcgaatacttgctttatccactggaactagctatcctgcgattagcagttcaaaattagccaatgcttctttgctggttccaattattgacgaacagtctaaagtaggattatccatatttaaaatagacagccttatcgctgccaataaagataaactaaatcaactcaaaaagttgaagaaatatttaatgcaaaatatgtttgtttaaatggtagattgcaaatttnnnnnnnnnntaattttacaatctaccaaatttatggattttttacgggctatccctgctgaatagcgatagtattaatttatttgtaagtgtcaattttagccaaatgaataattattcatgtataaatgagttagcggccgcacaagtggttgttaactcattttttggaggtttcttatggcacagcatgttaagtttcatcagtatttttttcagtggatgcagctctataaattagatgcggtccgtccagtgacttatcgcaaatatgaaatgtcacatcggcaattggtaacgttagcgccggatctaaagatggctgatttatcaaggctgacatatcagcaattgctcaatgattatgcggaaacccatgaacggcaaacgacaatggactttcatcgtcatttaaaaggttcacttattgatgcgttggaagaagggtttatcgatcgcgacccgacacggaaagcaattatcaagggaattaagcatcgtcagcataaaacaaagtatctacatcagtatgagttgcaggcattgttaaatgaattaaacctgaacaacgaagtcaattgggactacttcatcttgctgattgctaagactggaattcgttttgcagaagccttaggtgttactcctgctgatttcgattttgctcaccaaacactttcaattagtaaaacttgggattataaatctgccaaaagtgacttcgcacctaccaaaaataactcatcagtccgtaaagtaccgctggattggcagactgtgattcaattttcccagttgactaaaaagctgcccgaagatcaaccaatttttgttcaagcaaaagtttataatgatacggttaatcattatttggagcgtttatgtaagcacgcatctattcctgtgatttcagtccatggtttgcgacatacacatgcttcattattattgtatgctggtgttagtatcgcctcagtagctcgacggttaggtcattctaatatgacgactacacagcaaacttatttacacattattcaagaattagaaaaccaggataacgacaaggtcatgaaacatttagcaagcctaatatagacaataggatttacgttaataagtgcagattcaaacgtcctcgaatgttgagggcgtttttcagattatactcattggcagcgataaggttacatatgttctttaataaagcaatgattttctgttgttcagagataactggataccatacttctatatttgaaagatctctcaggtatatacctggttgcgccgaaatagatgttactctttgcaatattttttttatggtaggcaattgaaagctaaacatcaaaaaataattatctataatttcttcttttccacgtattatggctactgaacgttgaaaagcgattttatctttggactgtctataaatggctgtgcgccctatagttccaacaatagtcaaaagaaaatccccatcatttaatgaataccctttgtatattttattaaaatcgttaatactaatttgtcgatcatttttactgtagacaatcctatttgataggatattttttgcgcttaacaggtaagctccatagtgctcaatatgtgtaccatgtgtaccatccttaattacactagttatctcttttagcttacgctgctcccaagttttcaggcttatcggtcatatattaggaactggtacttgggagcagcgtaagttgaaattattagctgacttttcgaagggagccggctattcgaagaaagatattatagatcaaggtacacctattgtcttatatggtcggttatatacaaattatcaggtgaatattactactataaaagatacttttgtgaaagtacgtcctggttctgtttttagcgaatgtaatgatgttattgtacctgcttccggtgagacagccgaagacattgccagagcgtcgcatgtatgtatctctggggctgtcttgggaggagaccttaatataattaagcccaaaataaacattattgatagttcttttctggcactttgtatttctaatggtcagcaaaacaaagagctaattaaaagggcacagggaaaatctatagttcatttgcacaactctgatttgaaacaagtagtattaaaatatcccagcaaaagaaatcaaagtatgatagctcgtatttttgataaaaccgacaaccttatcgctgccaatgagcaagtcccaaagttagtcattaaaatagtaaagaattttctagctaattcattgcatttaaactaatggttatgattagatatggggcatttagcgtgagtgaaatgagataaaataatcatcttaagtacagtttgaaagttggcttcaggcacccggagagtataaatcaataattatgccacatttggtttaatactagtataattatcaagattaaaaataattatgctgatttgtgggtgcttctgcattatttgaataacaaccgtagaagcagttttgaaaaataccaattcgcaagccaagcaaaaatgccaagttgactagctcataatctggttaaccatagcaaatgaagtaatgtttccctaactacctaatcaaccgcaataacacgcacaccacaataatccacgtctttctgatcgccaaactgtcgcatgacctcgccgtgcgtgacgcaggcgatacaatcgtaagatgcggcatacttattcaaagttgccaaaactcgggccttcatttcagccgccgattcgtaggggcggggactagcagtggtgcgtttgccggcgtgttgtcgatagagcttgtaggccgtggccgcttgttcatcggtatcagtccgaatacccgtgttatcgggtagccactcgtgtaatccaagttcgacctttagtggaatatcattaaaacgcacaatttccagtgccgtttgtaaggcacgcgtgtagggtgacgacagaattaattgaacttgtgcaaataacggctgctgggcgcattgttgtgccagcataataccacggtcggttaagccgccgagttcacggccgaaaccagttaatccagctgtagtgacctgttgataagttggttcggagtgacgaatgagatagactttcatcgattaggacttccttcatcggaattataattattaatttcattataggcacctttgaccagaaaaaacgacacttcatttttcgaagtgtcgttttcgttagacctgatgacgttatgattgccgatttttaccatagaaaccgagtgtgacgacggataataacagtcctaggatgaccgctaatttgccagtctgttcgtcggtttgtggtaactgggctgaatgttcagtgacgggactcgttattttgaccaaacttacctggtcggccgtgggtttaagcgttggtttcacggtcgctgctggttttacagctaccgctggttgagtcggtttaataccgtctggctgcgttacggtcgttcctggttcgttaggcgtctcgggtgtggttggctcaacaggcttagtcggttgttccggttgttcgggatcaataatatcgtcggtaccagtcgtgtcagttgcttggtagacgtacgtgacgtccacgttatcagcagtgaagagacccatggcattttccggctgaccaacgagttcatgatcagtgaatgtcaggggcacggtttgataagtggttcccgtcttgccgctcagcacggttggttcgttcagtttaatgccatccttagtcacgtaatgtaccgtaacggttccttgggtatctggaatcgtgggggtgttttcagtgtaaacgtaggtcaaagtcttcgcggtagttccgaacgtcccactgacgtcaccctgcacagccttgaaggtgtaaccatcgataaccagctgttcagtcgagtagccgtcacccaaataaccactgagaacaacgtcaggatggatagacttaccatgctcatccagatacttgacagtgacgggtagcccagccgtccgttcgtagacgtaggtcacagtcttcgcagtagtcccaaatgtcccattgacctcgccttgaacagttttaaaggtgtagccgtcgataacaagttgttcggtcgagtagttgtcacccaaataaccgctgtgaacaacgtcaggatggatagacttaccatcttggtcctgatacttggcagtgaccggctgtccagctgtccgctcgtaaatgtaaacgacgcgttgtggctgcaaagtatagtttccagtcgtgttaccctgtgtcgattttaccgtatagccgttaatgttcagcggtgatgtttcatagggctgtcctaattgaccttgaccgcttaatacgctatcggcggttaactgctggccgttttcgtctaaatactgaaccgtgatatcgcccgcatcctcgcgagtgtagacgtagatgacagtttgcgcttggtcgctgaattgcccagtagcgttcgctggcgtttgaattaagcggtagttttcaatcgtcttggcgtttgtctggtaggggcgacctagctgaccgttaccggttaggatgtcgtcgggagctaaagtcgtgccgttagcgtcttgatacttcaccgtgatatggtcagcattcgagcgcgcatactggtaaataacagtttgcgtgtcggttgaaaaggtcccggtggcgttcgcgggtgtggcgactaggtaaaagttaggaattgaaatggctgccgtttgataggctgctcctaactgctctttgccgtctaaaaacttgtcaggtgctagtgggttaccagcactatcttgatacttaacaacgatctggccagcatcgcggcgcacatagacgtaaatgaccgtctgttcctggtctgtgaaagtgcccgtggcgtttgccggcgttgtcatcagggtgtaattttcaatgcctagtggttcagtcgtataagtttggccgagtgattgggagccggaaactgtcttatcgggctttaattggtgtccctgcttgtcttgatatttcaccgtaatgttaccggcgtctaagcggacatagacaaacgtgatgctttgcggatcagtcgtgaaaacgccagccgcattgccgatagtttgctgtaatttaaaatggtcaaaggttggcgcatctaaattgtaggcgttaccgagattgtgttttccaggtagaatttgcggttcgtagactaagttgccattagtatcgaccatgtgaatcgtaatgtcgccggcgtccttacgagtagtaataagtgacggtctgggcatccgccgtgaagacaccactggcattgccgacaatgttcgtaaagtcataatttggtagctcgtcatcaatgcgctgagtcgtgtaaggctgaccgacgattccgtttaaggtgaggtcagcggtgactaaggattcaccggtaagcgcgtcgacgtatttgaccgtgatgggcgcagcagtggcagctaagacatacgggcggacgacgacaaagttgttaccgtcagaagtggcagtcatgaaataataatcgtccatgggaataaccgtggtaccgttaaaggtcggacctgttagtccgggttgctggggcttcatattcgtgtagtagatatgaccgttgctgtcgtaattaccaccgcccgcaccgttaaagtaccagcgaacgtaaagctgaccgtttttgtagaaaacagtttcaccgacgccattattgggcttcagttgaactttagagccatctggcaaatagcaatcaatcgccagcgtcgcaatattattatctgcactaatataggcgggtggtaaggtgataaattggttactgaatgtgcctttcagatttttaaatcctttaagtggcgaaaaatctgaaatgtggttataggcggcatcgacctccgttaaattctttaagtttgcgagcggtgaaatgtccgtgatccggttttgctgaatattgaccacttggagtttttgtaagttggctaatggtgaaatatcagtgacatcactatagtaactgccagacggtgcgttcaagttgttgttgagccagactgtcgtaaggttagtggcatattgcagtccttctaatgagtaggaagtcttgccgtcgatataagtgtccttgccatagtaggtggtcagtagtagcatatctgccttagtgatgtctgcagctgagttccaggtacgatctgggttctgtttgcgcagttgactgagtacctcttgttgcaataatgtgttcggcatccaatcgttaatattttctgacgcggtgcggctaatggcacggacgactggttggttagatttcaaaaccagcttttcctggtttacattggtaacaattttatcatcggttgacgctgagctagtcgctgactgagtattcacctcggtggtagtggagttggacggcgcgggtgcggcttgctggcttggttgcttggaagcttgattatcggttgtcgttgctttagcttgactatcagtcgctgattcagtgtttgattcggtagttggttcagtagttgatgcggaggttgtttgagctggtgcggtttgagttgggtgcttaatatctgtggtcggtgttgattctgacgtggtagttgcttgagattgtgatgctggatttgctgattgttgttgtgggttggtgttcactgacgacgagtgctcagagggacttccggttgatgtggtgggtgacgtggctgcgactgctgactggtcggattttatcgtggatactgatgtagaagtatccgctttcaaattgacctgagtagcgttaacttgagtattcgtattcaactgactgttggtcggttcgttggttgtggtcgtgactgtattgtcggcagccgccgcctgactggcaatcgttaacgttgtcagtatcatggcggttgcgctcgtgattacccatcgcgattggtgacgtttattctgattattaacattgtttggtttcaaagatccccactccttcaaaatacttatataatgtcgttgacaatttaagggtaacattgtcattgccgttagtctaataaatgataatttaattattgggagctaattgtatctgtcaatgtcagctggctgcataatagttgacgtaagcataagattgattataatttaaatagtaataattactatttatcaggaggcacccatgatggaaaaacaagatttagcaagtgcgcgcaggcgtctacgggggaccaacttaaaatcgcggaaacgcgcattgaagattttacatgatgcccgacgtaacgccagtaaagccaaatagtatcagcgaacgttagccaatttggctaacgtttttttgttagctgtgcggtatgattaagatacaggaatgagtggaggacatgtggatggaaacaactttggtgattattcggggaaattctgggagtggcaagacgacgctagcgcaggcgttgcaacgacgcgtgggccatcatacgttgctagtgtcccaagatgtcgttcgtcgcgacatgctgatgagtcatgattacccgggaaatatttcaattggtctgattgaacaaattgcgtgttatgggctgggacgtgtgcctgtagtcattgtggaaggcatcttagcacgtgatcggtatggaaaaatattggcgcggcttagtcaatcgtttccacgcgtccttacttattattttgaagtgagctttgccacgaccttggcgcgtcatcaaaagcgtcatcgtgattttggtgtggaagacatgcgtcggtggtggcttccacatgatacgttgggcgttgctaacgaagtcttaattggcgagcaacaagatttaaccacggaagttcaacaaattatgactaccatacatgattgtgactaaacaaccatgagttgattggtttgatcgtggttgaggattaagctgaaatcataaagggggggcgagccaatgttactcgcagcattattgaaaacgcgtcgctgtcagtatggattgacacaggcacaattagcgtccaagttatttgttacgactcaggcggtgtctaagtgggaacgcggaaaggcgattccgtcaatcgataatttactggcactgtcggatctgtataatctatccttggatgaattagtgcgtggtagtgctttctttccaaagccatatattgttggtcggcgactaagctttgggcgacttctgggtctcggattattttggctatttgtttgtctattatttactggttttggttatcagccgtggtggctctttttatcactttatattgttggattgattgtggtcgttccagtgggaatcaatagttactgggtgattcagcctgctaccattgaattgcatacgtatgctgcatcgacattgacgaagtttcgccaaattgtgttcaattgtccacggtgccaactaatccactatacagatctgcagcgagttaccatcagttatcggtgtcgcaaacgactttcaccatttgatttcaatccggattattttcaattgattttaaagactaatgcccaaacttatcagctggaatgtgcgttgaaggccagcgactatttaccgcaatttgtcagttatttgcaacgacaaggtgtgacggttgatgatcctcaacaagttgtggaattgttagtttcaggaaagtcgttgtatcagcattttcataccgagacttgatcttgagcggttgcaaccaaccgttgcggtagcgcttaagtgtgttgcaatgaattggtgcactcaatagtctagtattgtaatagaggagcgggtaggatgaaaattgtgattggcagtaaaataaaagagcaacgacaacagcatgaatggtcccagcagacggtggcggagcggttacacgtctcacggcaaactatttccaagtgggaattaggaaaaagttatccagatttagagttattggtagcactgagcaaactatttgctgtctcaacggatgagttattaggtttgagcagaagacctgttcagcgaccatggtggcagttgttattgcgtaaaaggagtcgaacagatatgacggtgaaatggtacagcggggggcaggatcgggcacgtgttgctgtgggcataattagtgatttagttgctaatctaaataccacgaatgagcaaccgttacgacagctgctggcaacttattatcaggaactattggaacaacgaactggttcagtactgggagtattcgacagaatgaacttagacatctccaaatgtctgcggcagcaacaaatcaaactatcaccagaaaatgagcaactaatgcaacagctggtggggttgaacatgatttactaccggtgatttattttgaaagtaaaacgcaaactgtcaatcatctagcttaatagatgctgacagtttgcgttttatgttaaaaatcaatcgcagggttaaaggtttgacaagcttgttcgactagataagcaatcggtttagctagcacgtgacttggtaagtaggcaatactaaaatcaaggctgagctcgcttgttggtaatttgaaagcattgatagggtacttggctggttcagtgactagtcttgccaacattgcagtggctagaacaatgctaccaagtccttgaagtgtcaagcttagtgcaaagcgagagttatcgacttcaatgagtggaatcgtttgaatgcctttatcggcaaagtaatggtcaaccagttcttgaaagcgagcttcaccgactgcacggatgacaggctcaccggtcattcctgtaagaatggtgggggtgaacggtcgccaaaattgattggactgatatattccggctgtttttggaatgactaaagacaaagaaattgtctgcaaagggatggttttgacgttagtttgatgaattgttttgccaataaaaaagtctagctgatgactagctagcaacgtttctgcttttgatgttgtgatttctagtattttagtgcgaatgttcggaaaacgttgataaaaagcaggtagtgtttgactaaaccaagcattagccatcggtggtgtaatcccaatcgtcatactttgatacttattttgactgatttctttaagctcagtgttcattcgctgatggagacgagcgtcactttgcaaataagtcagtaatctttctccagcataagttaattcaagtggatgatggccgcggtcgattaagggggtcccaaaatgagtttccgcacttttaattgtgcggctaatgtacggctgactgatgaataaactttgtgcagctttcgtcatactattgtgctgttgaatagcttctaaaaatactaacaatttattttccatgaaatcgccacctttaatgcttaatcttattaaaatcaagtataacccattactcatttgtaataacagataatcagattgttatttctataaaaatgaaagcggttatataatacagatgtagtaaaaaaatgattctgtttgtgatttaaatatcaatttcaattgtgctttagaatacgttaaatggattttgaaagggtggtcagcatgccccaaaaaatgaatcaggttaaatgggattatcaatatgatacggtagttattggctttggtggtgccggggcgacagcagcgcggtttgcggcggatgcacatgcgaaggtgttgctcactgatgcagcgccgaatgggcatgaaggaggcaatacccgttattctgcccaactcttaggaacggtagatagtttcgatgagggtaaaaaatattatcaaaacttaacggcacccatgcaattagacgatagtatggttgatactttcatagcgggcatggcgaatatgcgcgactatgttcaaaagtatctcaatgttgaaccggtgagtgtcaaaaatgattttacagctgctgattctccaatttcattagacagtgcagttcatgagtttcctgaatttgatggagtccaatcctatgactttacaactgtccatcatggcatttttgatgcagctttgtggaaaattcttcgacaaaaagtgttagatcggcagcaacagattgatgtctggcttagtgctccggcataacatctgattcaagatcccactacgaatacaattatcggtgtccaaatcgaacgtcagcatcgtttagttaatgttcgagctaccaatggcgtagtcctagcatgtggtggttttgaaaataatcaacaagccatccaggactaccttggtgctgagcacttggcaccattaggcacgctgtttaataagggtgctggtattaagttggcccaagaagttggcgcggacttttggcacatgcaaaattatgaatcactcggatttttacatggtctttcgattgccgcaccacaaggtgaacgtggtcgcttgattttaggctggccgggagtgaaccatggtagcgttattacggtggctgatgacggtagtcggtattttgatgagagtgaagccaaccggcatggtcacatttatgatcatggaatgtggcgagtaccgcggacaaatgtccatccatacctggtttttgatgagactcagtatcaacagatgttagcaagtcaatatacgccgattaataatctcaccgatttagttgtgaaggccactactctaaacgacttagcacgagttatggaagttgatggtacggtacttaccaagaccgttcatgatttcaattattttgtcgagtctggtactgactacgcgtttaatcggcaggttgatacgatgcgggcatttgatgatggaccatattatgcgcttaagttaacaaacaacgtacttaatacccaagggggaccacgtcgtaatgaccgggcagaaattttagatgcaaatcagcaacctattccgcacttgtatggtgcaggtgagttgggcggtatttgtgcaaatcagtatcaaggtggcggtaatttagctgaatgcctgatttttggaaaaatcgctggtgaaaatgcagctaaacctaaggaagaaacgacacaattagtcgatgaaaaagcagtggctaagccggatgcgaatactagtgcttcggtgcatcagactggtgccaatgatttgctagctgaagcatcaccggacatcacagttggtgaacaccaatacttagggcgctcagatgatggcattggtgggcaaattgtggttcgtatcacgtatgttgaccaacaattaactcatgttgaagtagttgaacaacatgagactggtgaagttggtggtcaggcagttgccgaattgccggcaaaaatggtggctgctaacacttatgatgtggatgcagtttccggcgcttctgtatcgagccgtgccatcaaggccgcagtcaaggacgcgctatcccaggccgaacagaccgtgtcaaatgattaaccactgatcggcacaacccacgaatcacctagtgcttttagtatcttttagtgcgtaataccggtaaactagaattaacaaattcaatcaatggaggccgctcatgcgtattacaaaaacgagtttgatcctcagcagtttatcattggtactcaacacgttgtcattgattatggcaattcgcaagtatcggttacaaaatcactaatcattagaaattcaaaaacaccgctgtgactaacgaacgcgcattagtcgtagcggtgtttttggttttattaagcttcataatccgtcaaatcagccaagaagcgttgaatcaccgcaagttctgctggtgagtagtgttcatggaggagcgtgattgcttgatgattgcgggttgcatgcatcttatcatgatagcgggccagcttacgaccactcggcgttaagcggtagaagatctttttgtgatcatcgggttgctggaatgagccaattaagccctgcgttacgagtcgtttggctgcccgggtcacaccacctcgagtgacgccgaggttagtggctaagtcgatgcccgtttgtggaccggcctctagttcagataataaatgtaggccaacgatggaaatatccggcaacaggcggcgtagattggcttcggtgatatgctgctgtaaccatttctgttcaccagtagtggaagcacgcttggttcgaatcgttttgagctgcgttagaattgtctgttccgtggatattgacatcgattgatcccccttagatagttgtgcgtcacggcgattggttctcgtgttggttagcgcgcaattatcaattaatcattagcttttattactattattataccggttttaaaattcaccggcgagtttttctgctgctacctgtgcggcagtgatggcctgttctcgctgttctggaaattggtccaatccttcaatgaagatggttcggtaatcctgaatcccataccgttgcatcatgccacggaggtaggggtcgcctgcttcaacctggttgtgttgatcaggttggtgatagtagccacccgcagcctgaatgtgtaagacgtgtttgtcgggtaataagccgaccgggccgttgaccgtgtacttaaaagttttacgggcgactgcggttaagtctaagtattgtttgagttcggctggaagaaagtgattgtacattggattaacgaagacgatcttgtcggctgctagaaattcagctagccaggcggcgtgacggctaagtagttcagcttccactgacgttagttcttcaccgtgtttttgtttacgccaagcttcgaaggttgtgtcgttcaaagcgggaacgccgtcctgataaagatcgcgtgtcgtaatctcatcgtgcggatgggtttgctgatacgcagttttaaaactcgctgcaacggtcagtgaggcactggggacggtcgtgtgtggatgagcattaatcattaataattttgtcattttaaacagctccttaattttgttgacaagcaacattttatcttgaatattgttgcttgtcaacaaataagagaaaaaattccccacacattcgaaaatgcgtggggaatttaaaggatgcacgattaattttgattaaccaatgctactagcactaggttggagcgactttacgggtaaatacggtgcaacatacgtggaaacggaatggtttcgcgaacgtgatcttgcaaagtgatccaagccagaaaacgttccagacccataccgaaaccggagtgtggcaccgaaccatatttgcgtaaatcgagataccactcgtaatcctgcaagtcttgaccgctggctagtaaccgttccttcaagtagtcataatctgttgagcgttcggaaccgccgatgatttcgccgtaaccttcaggtgctaacaggtcagctgcaatgacgacatcatcgcgcgtcgggtgtgcctgcatgtaaaaggccttgattgctttgggatagtttaagacaaagactggttggtcaaagtgttctgccaaaaatgtctcttccggtgagccaaagtcgacaccccagtcgacgtcaaagccgttcgcttggagtagtgtaatagcatcgtcgtacgaaactcgcggaaatgggagcttggtgtacttttgcaacgtcgcaacatcgcggtccaaaacggccagttcgtgggggcaatggtcaatcacggcttgaacgaggtaggccaccaattgttcttggacttccagactttcatcttgatgcatccaggccatttcaggttcaagttgccagaattctgttaagtggcgacgagtcttggatttttcggcccgaaaagttggtccaaacgtgaagattttgccgaacgccattgcgccagcttcaccgtataactggccggattgtgataaataggcgtcctgaccaaagtaatcagttttgaataattcagtcgtcccttcaggagcggaaccggtcaaaatcggcgcgtcaatcttaataaaaccgcggtcattgaagaactcataaacggctcgaatgacctcgttgcgaatccgcataattgcgttgggacgcgatgaccgtagccaaagatggcgatgatccaacaggaaatcaataccatggtccttgggcgtgatcgggtagtcgtgactagtcccaaccacttcaaattgtgagatggcaagctcgtagccaaagggggaacgggtatctgcatgaatcgtgccggtgacccagaggctagtttcttgcgcgaggtcggtcagttgtgcaaaagccgtttcaccgagctcgtttttgagagctaccccttgaaaagttgcagtgccatcgcgtaattgaagaaaggcaattttgccgctagaacgcttattactgagccacaccccaattttaacttgttcattgacatggtcagcggcgttgataatactaatggtttccatgatattgatcactccttcttgttggattttaaatcagattaaagtaaatgaatgttatgttcggcacattggtcgatcatggcttgtggccacaaggcagcttgtacttcaccgacatgggctttgccaagtaataacatgcagagccgtgattgaccaatcccgccaccgatcgtgtaagggacgtccgcgttcaagatcatttggtggtatggcaagctaagccggtcttcggcgtccacgtctttaagttgtttcttcattgattcagcatcgacccggattcccatacttgagatttcgatagcttggtctaatggttcataccagaagaggatatcgccgttcaatttccagtcatcatagtcgggggcgcggccatcgtgacgttcgccggaatcaagcttccagccaatttgcattaagaagacacagccgagtttcttgcaaatggcgttttcgcgttcgcgcggcgtcatgtcagggtacatgtcttcgagctcttgtgtggttaagaagtgaatttcgtctggtaagtggtgaacggcttgtgggaacttgtaccaaacttcgtgttccatgtgcttgatcactttaaagatttgacgtaccgtggctttcaaagtttcaacggttcgttcttccttactgatcactttttcccaatcccattgatcaacgtaggcggagtggtaattgtccaaatcttcatccttacgaatagcgttcatgttcgtgtagagaccttcatgcatatcaaaaccgtagcgctttaaagcgacccgtttccacttagcaagtgagtgaacgatttcgatttgttcatcacccatgtcttgcatagtgaaggagacaggtttttcgacaccgtttaagttatcgttcagaccagttttcttttcaacgaacatcggtgctgaaagccgagataagtttagttgcttcccaaattcatcttggaacgtttcacgaatgtaacgaatggcctgttgggtttctttaacggataatttaggatcgtaatcctttggaataattaaatgcatatgcgtggtctcctttaaaataagttcagattttagttacaggataaaagaaaagagccttccatcccttgaattatcaagggacgaaagactctttcgcggtaccacccaagttgtttaccttacagtaaaccagctttaaaatagtgtacaaacatacaccaccgatggtaacgtaccggttaacggctaatcctactttaacgaggttatttcagttagcaactaagaaagtgtttttcggattagtcaagttctggtcgggtttccactcactcccgattcactggcaggttgactaatcgtactcctctttcctccgttttttatcttgtgatatttatattagcacgattctggtatttgtaaaccactaaattaaaaataaattagtttagtctcatgaattcaccataaaaatcttagctaaaaccgcaagctaccgggcttaattaatcgttcaaattataacgtaatttcattttttcagaaccggcaatgaccatatcgccgagtaatttagtttgtaacttcatcgcggtatcggccaattgttggttagccgtttcaagataggccgtgacgtcttggtggttagccaagtcagcgtcggtatcattctcgattttacggtaagcactcatggcttcgagttcgtaactattccgcatatccacgtaaaagtcgtagtcggtgtcacccaaaagggcggttgtacagcttaaccagtacatgtggttgagattaaaggtgccgtccgcatctttgtagctagctggcgtgtcattgacatttgcatagaatggtacgaccgtgttaaaggtattggcaccaaaggctaaccagtgaataccggcaacagcagcggggacgttgttgcgaatctgtaagatgtgcacatcgtggttacggttgatcccgattggccggaaaagggttttgtcagcttcagagccactcccgtaaacatcgtatttcgtgttttcaaagtgagaactcaaaacaaacttgacgtcttcgatagaaatcttacggttagcatggcagatgaatggtaagtcttgttccattggatcttgcacaacgtccggcgtgaagtatttctgaccgaaccaagcccgggggttgttgtaaaccgtatctttgattgaagcactcccaaagatgtgccgcaagttgacacggtcaaagtcaggattcaagtggtaatcttcaattaattgttcaaggtcagctgaagctaaggtatcatcagcgttaaaatcgaaatcgtcaatattcatgcggttcggagcaaccacgtaagcatcgtcaggaatacgtttagcagcccagtggtgaccaccaatggtttctaaccaccagatttcgtcttgatcagaaaaagcgataccgtttggttcgtaagtcccgtattgttcaagcagggcacctagacgagtaacgccttccttggcgctgtgaatgtatggtaatactagggtgcaaaggtcttcttcaccaattccgccggcaacgaagggatcgattcccaagatacgcgagttcgtggtgatggtttcggttgcggacatggcgatgttctcactgttgatccctgctgctggccaggtcccattggtcaagattgagttgggaattgaagtataccgtaagggattgtcaggtaagtcgacttcgaccttactaatgacggactgatagtgccggggttgatctgcgggattgaccacaactaatcgttcggggtctagggcttcgtgaccatcatcgtttcgtgaaataatggtcgagccatcgattgaggcttttttaccgacgagaatcgtggtacatgaacctttaatacgtttttccatgatattaaaacactccttttaagctattaatatcattatacgctttctgagcgggtcgggatagaacgggcttttttgagaatataattaatcccgctaatactaaaaccggtgaccgccgcaatttcacggtaagtcttgccacgtgcccgtaactggtgaacttgcgcgtggctggcatgttgtggtgtggggctaggcgtctggattgacggaaccaccgctggcaccgtagctggtagtgcgatcggtgcaggcggtgtagtgattaccggcgtttggtgagttagttcagcaagcttaaccatgactaattcagttgtctgaacatcccaaatggcgttatgctggtgtggattgctgatattaaaaagtgcggctaagccatttaatggcagatcatggctaccgaccttatggttgccacgattgatcaaggtattcgtataggcttgggcatcaaaaatcgtgaccgggcgactgactagctgctgttcggtgggggtcaattgctgataatactgagttagtaataatcgaatgtgtttcatgtcctgtgtctgatcccaaaaaacgagggggagttgtggctggataacttgctggatgaatgcttttagaatcgtcaaggggtcgccttgcgcctcgtaagcgacggtcgttaagccagttgctgataaaccggccaactttttgtcaggtaaaaagttaggatcatcgaagtaacgattgaaaaaaggcgctgtctgcgtatgatgggaaaaaccgatggcactgagctggaagatactagcccgtaattcgggtgattcgatgacgtgccaactgacggctttagcggagccattacgacgaaagcgagtgccgaactcgcagtcgatgattacgtaagcggtcggacattcactcaattccgttggtgaaggtaggatcgtgggttggcttagttcaccggccggctgcgcagggggaaactggtatcccagcgtcgccagaaattgaacggtatcctgcccgagctggttattggttactttagcgaccttcttttcagttaagacaatttctttacgcgccacgaataaaatatgatagcgctgctgttcatcacagataatttcggtcacgttgccggcaaggctgtattctgaagcgagtgctaattgatggtccttttgaatacggtaaacgggatggttgacaaagtatagacaattcaagttatttgagatcttacgctcaagtaaggttaggttcgttggcatcatcgacaacagctcctctgatctaagtacttatattttagcggctttgtacattagctggctagtgtttgcactgcagatcgaaccatgaatttggtaatcacgaattggtgcctggtgttatagtgaccgtagagtgctagttgtgcgtcaggttggagttggtaaaataaagtcaatgcatgcttgacgatgatgcagttgatgggcgtaggctcggtcgcctttaatggcgtgacttgtaagtacaacataaaggggtccaactttaatatcttgcttttatttaaatacttaacggttagattttctgactgcatgctaatcacctcaacacgagtatacgaacatatgttcttaaatgcaagcaaaataactgcgttaacaaatttattttaagatgagcgctaggtgcgctggactgattcgaaataatttattaaaaatcgcaacgaatcaggcaagtcacggggaaaaagctacaaaaaattgagaactcttggtatgatgaatagtagtgaatgagaggaggccgagtcatggatcgaggacgacgcgcaacgctggaagaacgaattgcgatcgtaaagtatacgctggaccattgcaacgattatcgagaagccgctaagcattttaatgtttcgtatccacaagtctatacatgggtacgaaaatatcgacaacacggcatggaaggtttggtggatcaccgtggccgacccaagcaaggctaagtcagcattgtacatataaactgtgtgggcgagtgccctttgatggccaatctgacatggtcgtttaatcgatatcggtctctttaaagtgtccgttcctataaaatcaatagggacgggcacttttcggtattttgatagttttcgtggcgcaagtgcgacttaacgtacctagtgattaccggggcgcgttcttgtcatgggccggtattctcggtagaatgagagtattaattcaaagagggagtttacgtgtgatgattgacttagcggcggcacagcaagtattaaagaccacgttcggatatgatgaattccgaccggggcaaaaagcagtgattgaacaagtgttggccggtgaaaacaccctagcgattatgccgactgggggtggtaagtcattatgttaccaaatcccagcgttactttttcaggggctgaccgtcgttgtctcaccattaatttctttaatgaaagatcaggtagacgcgttaaatgataatggcatcgcggcgacttttattaacagttcactggatttccaagagattaacgaacggcttcaagaactacgggcgggggattataccttactttatgtggcacccgagcggttagattcggattattttattcaagcgctgggccggttgcccatccaactgttagcaattgatgaggcccactgtatttcacagtgggggcacgattttcgtcccagttatttagcgctcagcacggcgattgaacaattgccgacccatccgcaagttctagctttaactgcgacggcaactgagcaagttgctgcggatatttgcggccgcttagcgatcgatccacaacatgaagtgaatactggttttgcccgcgataacttggatttgacggtggtcaagggccaagacacggaccgttacattttagattatttgaaagttaatcatggtgaagccgggattatttacgccagcacccgtaaagaagtgatgcgtctgacgagtttgttgcaaaagcatgatattaaggccacgccgtaccacgctgggctagatgatgcggttcggcggcaaaaccaagaggatttcttgtacgaccgtgttgacgtcatggtggcaaccaacgcgtttggaatgggcattgataagagtaacgtgcgttttgtgattcacgcgcaggtccccggaactttggaagcttattatcaggaagccggtcgggctggccgggatgggttacctagtgaagcgattttgatttttcgaccggttgatattcaacttcagcacttctttattgatgagtcggagatggatacggagcaccgacacctggcgtatcagaagctacaggtgatgacacggtatgcgaatacccagggctgtttacaacagtttatcttgaaatactttggtgaaaaatccgcgccgtgtggtcggtgtagtaattgtactgatcagcgggaatcacaggatatcaccacggcagctcaacaagtcttatcgtgcgtcgttaggcttcattcccggttcggtaaaggggtcgtggcccaggtattgacgggcgctaataatcaacgggtccgcgaatcgaacctcaatacgttgtcgacgtacgggttgatgtccgggcagcgacagaagagtgtcgtggaactgatcgattttttgactgcgagcggttatttgcagtcggtgggtggtcagtatccaacgctgacagtctcagcgagtggagtggccgtgcttaaaggaacgaccacggtacaccgaaagacggcccaaaaggtgcagcagacggtgccagagaacagtgcactcttcgaacagttgcggacacttcggcgccaattggcggaagaacagggcgtaccaccatttgtgattttttctgaccggacgcttcattcgatgtgtgacctgatgccagaagacgacgcagctttcttaacggtcaaaggggtcggggccagcaaacttgaaaagtatggtgaaacctttatggcgacgattcgagcggcagctcatgcggaatcagcaactagcaccgatgaggaaaccgattagatggctgattggtaaactacgagatgaaatggagtaacacgtatggaatttacttggcaacaccaggggcaaccaatggcaatgaaacgattcctgacgacgcatgccatcagtatgcgaacaatcaaggcaatcaagcatggcaccggcgcgtttcttgtcaataatcaagttcaaacgggcgttattaccattcatgatggcgatattgcgggaattcaactaccagacgaggcaccggatacagcggtagccgtcagcgaacaaccaattcaaattgagtatgaagatgctaattggctcgttcttaataaaccagccgggttaaccagcgtgccggggcctagtaatcggaccgatacgttggtcaatcgaatcaagggttatttgatagccagtcatgccagtaatcaacgaccgcacctgatcacgcggttggaccgggatacgagtggccttgtgttagttgctaaacatcgggtggcgcaggggatgttgacagagccccgaattgcggcgcaattagtgaagacgtatcaagcttggattgaagggaccattacgccggctagtggcacaattgatcgcccgattggccgggtggctgacagtcctcggcgagtggtcaccacggcgggccaacgcgccattacgacgtatcaagtggaggcggaccaattgcagcataacgtgagtcggttacggttggaacttgtgactggacggacgcatcaaattcgggtccatctaacgacgcttgggcaccccttattaggtgatgcgctgtatggcggtaacttggcgtggattcaacggcaagccttacacgccgctagtttacagttctttgaccccttttcggaacagactttacactttgaggcggcattgccagctgatctgcaagccctgaatcacgactaagttcagtttaggaccagtgataatccggatgaatggttaataaaaatcggcactgctagaatgcgttgaacattctggcagtgccgatttttggttggcaaccgtctaaaatcaagctaacgtttagcgggtaagttgcaggcctgcgttatcctgaaggttgcggtgactattgaatgaggcgctagtgcttacgactgactaagtggcgcgttatcagccgttagcgtcgcaaaagttgcctgtaattgctgtaatggtgcggttaacgtgagaaaataaatatgctcgactccgttactgcgcatatcaatgaccccagcttcacgcattaagcgtagatgatgtgaaacggcggggcgtgaaatattgaccaaggcggtaatatcagtaacgttgagaccattatcactgttccccagagcaatgataatctgacgccgaattttttcggcgaagatattaattagtgtggcactttcaataagtgccgtttcggattgttgaaaattagccatggtgactgcgtcctttcaaattcaatttacacttaaggactaactccccccatcggcagtacgctgaattagttgttaagtgttggtatgacagctcgatgttcaagttctggtgaaatagttgcagccaagaaaactttaagtctacaagttgtcagttagactaattgttattggaacgttcgtacttatgtataattaaagcaagtcgttaatcgattgtcaaacctttttgttaaaagtaagtactattagcgggtttaacaattgctgttcgtttgataaccatatttttatgttgaaatgcgttaaaataaaaatagcttttgaatgaatgatgggagtggaaaatgtgaaagtcttaggaatattaggttcgcatcgcgctgatggcgtgactgcccagctactgcaagccgtcttaaagggggccgcggccagcgctgacacggaactagtcaacctcaacgattatgagttgcgaccagatcacgatagtcaaccgaatgctgacttagacgcgctggaagcaaaattaatggcggcggatgtctgggtattagctgcaccaacctatttggggagcttatcgggggtaatgaaaaacttctgtgactgttttcgggggcggatcgcacggtttaattccgtgggtgaagcagtacctgatcgctttaagaacaagcattatgtgacgatcacggattgttacgcgggtggtattgaaaattatttgaccggcgtgactgacgcaacgtttaaaacacttgataaatttttgacgatgggtggtctcatcaaattacgggagattgtcgtaactaaaacgtggggtatgcaaaccatcacagctgctaagcaagcagaatgtgaacgggtcggcgcgcgggctgcacataaaaaggaaagggatgacagtacggtgaaacggtatattcaattattcttcatgattgcggtgatggcactactaaccatgggaatcgaagcggggattcaacaattgattccgctgaacaatttttgggcctactacggcgtctttgtcgtcgtcttttatgttcttttagcaatgattttacatttcttcactgttgttaaacaccggcgtcgttaagggatacggcatgtgcattcagcaacaacgacattaaaattcaattgattagcaagctgggcttggcgtcttaatcgccggaggtcagcttgttttgctataataagaacaattacgaagtaccagcgattatttcagtgtccacgcgtataattaatatggtatcgtcgaattagaaaatgaggacacttggtactggttgccaggcgtatgaaccataattaaaacatgttaaattagatgaatttttatttggcagcatgctgtgattggtttcggttttggcgcatccaagctgccggtttttgaatctaactttgtcaaaaactaatcatgggtcatgcccaaaaacgtattattgatttcaaaattaattttgttaaataaaggctgtcaatcaaggtacgaggaggaatagcatgcaagtttttggacaatttattgcaacagtcggttggctaggattggcactagtcgccagcgaactaggtgcgacgttaattcattggctcggtcagtgggtcggatttcgattaattggtgctcgaattgtccggattaccggttttcgacttcaattaagtcgggttcgtggtcattggaaattagaacgaccgctgacgcgtcatccacatatcgtggcagcacccccggcggatgccaaacggttcaatcacgccatttattgttttggcggtggcctgttcaacttactgacggtcatgctcagtttaataactctgaatcaatttaagtttagtttcgatttatggttgtttgcgttcattatttggatctgggtcaatacgttgaaagccgcccaattattaccaatgaacttgcacggttatcccacggcgggccaggaatttcggcaggcacgcgaatcaacggcggcgatgaccgccgcgtatgtcactgcgtgtgctgcggccgttaaggttcagaccggtagtgtccgtgaccttgatgcgagtatgattgttatgccgcgcgatggtggcaatcggaattatttagtcgtccggcaagcctggttgattctggaatggggacttcaacatgggctggacacccccgaactgttagcggggttgagtcgcttggagccaagtttcaatacgttgccgccagctgatttggcgaagtatttagatgcgacattgtactggaacttggtcaccaatcatcgtgacccccagatcatagcctggtatcaagatgatggtgttcaacagttattacgtcgttaccaacctttggctcattataagttaactgccgtttatgaatggcgggtccatcagcaacctgaacaggccctggcattgattgaaaagggaataaaaattgctcagcgcctccacgatgaggaagaaattgcttggctgaaagctttacgcgttcaagtaacggcctagattaccgtagaaccttagattctgttaaagattgccagaatcgaagtttgtattggaaaatgggtggtaaactggtgaccattgaagtgaaaaaaggtgaaaatgtgaaacagcgaatcaagcaacggtgggggttgtggttaacactgctggtgattattttaggactaatcggggttggattgacccgagttaatgcgggactttatcagcagacagttgcacaagtgacccacgtgcagactaagagtcgaagcacgacgacggatgaatttgagaataaggatgcgacagtgacacagttggtaacggtccgggtgctcaataaggcacatcgtggtcgaacttaccagatcaagaatacgtatacgcgctcgggcgcaatggatcagccgtatcacgtccgtaatcaagttttcttacggattcctagtgatcatagtagtgcagtgacgattcaggggttaaaacgagataccgcattggcgtttgtcgcgtggttagccctagcactgctcttgttaattatgcgtttcagcggtctgatggcctttttgagtgtcgcactcaatgctgtactattttatgccgccattcagatcgatttagctactaatggtggtcacatttacctgctctttggcgtattggccgtaatcttcgccgtgctcacactgttgctagttctcggttttagtcgtcaaatgttagtaacattgggcgcgactgtggttggcacgggactggctgtcattattagtctgatcgtctttgcggtgacccatgagcgtggtgtgacttatgaatcgatgcagtacgtgacgcaagttccccgaccgttatttttagtcgaaacagtcctcggttcactcggagcagtcatggatgaatcaacagatattgttgcttcattgtttcaactgaaaacggagcgcccggacattgcaccacgacaagtatttaagtcgggtattcaaattggccggtctattatggggcccttgatcaacgtgctatttttgattttcatggcggatactttcgcgatgactttgctctatttccgtaacggcaatagctggggttacacttttacaatgaatatgtcgttggggatggtccaaagtttgatttctggtatcggtatcgttttagcgattccagtagccagttggttagccagtcgattgatgcctaaggcggtgatggcatgaacacgattaccgttttaggattgatcttactaggcttgatgacattaattggtggtaagactggagcgacggcctttttgagtttgttatttaactttggattgttgtttttagccgttgttttgatttcatggggctttccagcaatgggggtgtcgttggtcattgggacaatcatcttggccttcacgattttctttggggaggacaacgaagtggcggccaagccagcttatattgcagcattgattgttatggtcatgttagtgctgattatttttcccgttgaaaattggatcatggcgcagggctttagtttagaagatagtgaagatctggaaggtatgtcgttagccattggggtctcctttattggcgtagcagtaactgaagcaattttaagtacactaggggccattgcggaagctgctattgcgattgcggctggtctgagtgaaattctggcgcagcatccgcagttgccaactaagcgactctatatcgatggtatcagtattggtaagcagattatcgggacgacttttaataccttgtttttcggcttttttggtggcttcttggcgctatttatctggtttgcgggcttacattattccttcgggagtgttatcaataataaaatatttgttgcggaagtattaatggtattattctcgttaattggcgttatcctggtagttcccgtcacgacgtgggtgatgacgattcaacatcggcaacaaattaagcacaacgattgacgatgaccgcgggatttgctacggttgagaaaacagttgggagcgttgtgatgatggaaattcgaacggcataaccgcaagatagtgctcaaattgcaccattgattgcgatgatttaccgtgatatggaaatgccagtcttaaaaaatgttagcgaggccgacctattggcaatgttgactgagttgtatcagcgaccggccaatttagatgggttagcgcagacttttgtggcggtcatggctcacaaaatcgtcggtgtcgcgtttgggcacttagcgaagaatgaagtcgctgtaaacgatttgttgcggacgacttcaggtcatcatgcggggtttgaggcaccactggaattaggtggtgagacccggccgaatgagtggtatttaagcatgttggcagttgatccgcaagctcagggccacggagttggtagtgccttactagaagcattaccaggactcgttggtcaactgggggccacgaaactgagtttaaacgttgatgatggcaatccccgggcagctaagttataccaccggcatggttttgtcccggatggtcagctcatgattggcacacatccgtaccagcacttggttaagcctttatcataataactgaaatatcgtggtgtgtttcttagaccacggtatttttttacgtcattatggcactgaagacttttctattgagcatgacacagttagaattaaactattgaacggattaggaaggtgaacgtgccatgcagatttatttcattcgtcacggtcgaacacaatataacttagaacaccgatttcaaggtggacgagcagattccccgctggttgctagcggaatcgatggggcaaaggccgctggtgattacttaagcaccactcaattttcagcagtatatagcagtccgcagcaacgagcgctggatacggcgaaatacattgtggctgccaatcagtggcaaccgccgattcaaatcgacgatggcttgcgtgagtttgattttggtgattgggacggcaaacaggaagcggaagtacagccgcagtcctacgcccaagttatttttactaaacctgccgaataccgaccggaactagctggcggtggcgaaagttatgcggattttgtcacccgaacgacttcgacactacatcgtttgattgatcaagttggggtagctagcacgcaaccactattaatcgtatcgcacggtctggtgacgacgatgactgtcaaggcgttaatgggtgtccccgtagcagaattacgagcaccttttgtggtcgatgggcaagttatgaagacagtgggccacggtatcgtggataatgatagcctgacagtgttatcgacgacggataatctgcattttgaactgacgacttggaatgaaaccgggtacttgaagtaaatggctgagccaagtacaacgccttactttagctgttaacttgactctgatcgataaaattttaagtagttagtaaagggacgcttctggcatggtttgtcaggagcggccctttgaaattaacggttgattcaagttatttgtctgtgttccggttcaaaactgttgttaatatgatttatagtgagcgctcgcacgtgatagtgctttaccacagcccactaaaaatactagctgccgccacgccccaataatattcggaggtgcgggcggtttgggtgtagagtgtgttaattgcttggagtggttggtgcatgtgatcacgcatgacgcgcattgccatgccgttaactttagtggcaattaataaatagttaccgttcttgtcaagttccatagcatagcgaagtaagtcagcacgaacttgtgcgtcttgtttaacttcaggatcattataggcaacgtcgatttgttgcatcaaacgcttggctttatcatttttgttcacgttaatccccccatgccaagagtatagcacaagtctcagacttaaatgttagcttaacgcgaaaccgcccgcatttcggatagtaaaatgcggggcggtttttatcagtccgcttgttttttacatgtgatttctgcaacgtgatactggtgatttttgatatgccctagtcgctaaattaacgcggccgccatcacttgggccacatcttggctttgccaatactgatccactaatggtgcgaaagcgtggttcaagccctgatactgaataaacgtggtcgcagtatcggcagcggccaggcgttgtgcataagcccaagcttgtggtcggaatggatcaaactcgccgaccatgatcgtggttggtggtgtcattgtgaagttttcctggtgtagcggtgagatgagtggagaatgtgaatcaaagttctctggaacataataatccgtcatgatgctgtcaagttgccgaaagaggtcgtgatagttggtgagaatggcacgctgtgagtcaataatcggaaaggcggccaaatcccagagtggaccggcgtggtcagcatttggggcggtaactgggtacaacagcagttgttgattgatacgattgctaccgagttgttgattcagatttgttgcagccatgatgacgttagcgccagccgaatcgccagcaacggtaatcattgtttcagcgtcacgttgttccaaatattggaaaatcgcgagcccgtctaaaataccagcgggtgctggtgcttctggcgctaagctgtaatcgacattaagaatctcgcagtgacttttagctgcgaccagctttaaaaggaccgtattattgccgggaacaccgccgtaaaaggcaccaccgtggaagtagaccagtactgtgtgattaatgacattttgtggtgtcagccattcaacgctgaccgtgcgattcagagccgtaatatttcgactttgaactgtaaccgcatcaccaacagggtccgcgatggcgggggttaaactaccactgcggagcgctgctagatcattttcaaggatgggtggttgtttgaaggccgttagtgtttgaaggacgtgcgggtcaaattgttcaccggcgatgtcgttgttaaatggtttaacgattttgacgacgccgttgacggttgtttgaatcgaattaattgttggcatcatattcaacatcctccttaggttcaactttagccgctgcgtcggccttgttggcttgtaattctttttcgtctaaccgatagaattgcatcatgaaaatcatcgcggctaataaaataatcggcatccaaataaaagcgagattaataaatgtaatggttcgtccggactgtacagctgccttggcattgaattgtccccatgcgagaaattgaccggctagaaaaccgccaattcccattcctaatttggcgccaatcattggtacggcagataaaaatccggtttcatttaggcccagtactttcgttgagtagtcaacggtatctgatagcatcgcgaagacaatcgtgaacgtgatccccatcgcaatcaagaaaatgacggagccagcaattagtaggctcacactacgcatcttttcagcgattggcagcagtagttggccgataacgcccagtacgagtgaaaactgcaaaacgttacggttcttaaagcgttgtgataggaatggtacggacaggttcccgatgacggaaacaaagccaatccccaggaaaattggcgctaattcaggccgaccgtagacgtatttgataaagaagatcgctgaatttccccgtagcatccagaaggtttgtagcagaatgaatgagcaggctaataatagccatggtttgttgctagccgcacccttcaagctttgccagattgagagtgattcggctgactcagtggtaccgtctggattttgtgcaccgttagtttccttgagattgagaaaagcaaagatgaagagtcccatgataacgaggcctaagataatagcccagagggtgaaacctttcgactgattgcctttgccgagtaatttaaccattggcaaagtgatggcagccactgcactggtcccgatggttgtcatgaccatccgagcactcgctaacttggtccgctcaacgctatcatcagtcaagcttggtaaaatcgaagtaatgggcgtgttggcaccagaataaatcaggctaaagaaagtgtaagtgattgaaatgtagacgagtcgcattgtggtattgccgccaaatgatggaatcatgaatagcgacatggccagcaaccctaacggaatgccaaaccacacaaagtaggggcgcgattgtccatacttcgtgtgtgtatgatcaatcaaataaccataaatcaatgcatcaaacgcatcaatgaagcgcacgacgaagaacagcattcctgcaaaagcagctgagatgcccgcgaccgttgtgtaatagaacagtaagtaagtgctgaccatttgccaaataatattaccggccatgtcagtggaaccgtatgcaattcggcgtttccaagtttgaaaaattgacattataaatccccccaaacgaattaaacttaaactaacaatgataattaaccccttttatcaacataattatatttccaaattaggtgaattatcaaagataggcgatagtttggctggttaataatcgaaaggtgggtgcatcttttgtacaaacacgactgatgcctgttttgtagcgctggttgggagaaagccaaacaagcaaaaaacacccccagcaacggccaatcaaattagctgttgctgggggtgttaatggttaaagacgcgtgtcgcggatgtcaccaattgttaacagaaatagaattgaaaatagccttgtcggtcagttctgttttgaccattaatcaatggttggtttcagagctagtgttttagcggcttcttcactgtcatcaaagtgatgcttagtccggccgatgatttgataatcttcgtggcctttaccagcgattaaaacaacgtcgccgggttgtgctgcttcaatggccttggcgatggcaacgtggcggtcttcgtagacgggcacgtcggcgtttggcacgccggcaaccatgtcatttagaatcatggttgggtcttccgtccgaggattgtcagaagtaaagattggcttagtactgtgttcgacagcaattttagccatctttggccgtttcgtcttgtcgcgatcaccaccacagccgacgacgcaataaatatccttagtcgcgaaatcttgaatcgtttctagggcattcaataagccgtccggagtgtgtgagtagtcaacgatgacactgacacccgtgtgggaaggaacggattggaagcggcccttaacgccggtaaccttctccagtgacttaatgatttggtcttcggggatgccactagcgtaagctgcggcgaaggccgccagcatgttgtacacgttgaactggccaatcagttgcatcgtcacgtgggttacgtggccgaagacggagaggtcaaattcagtcccgtggctcttgatttcaacattttgtgcgttgatcatggcatctggtttgagtccaaatgttagtacgtgcgctgccgtgtactgttcaaattcacggccaacgggatcatcggtgttcagaacagcgaccttattagttccgtcggcgctgtacttattgcccagttgtgcaaagagcatggccttggcttccgtgtacttagccattgttttgtggaaatccaaatggtcttgcgtcaagttcgtgaaaacggcgatgtcgtaatcaatcccccagacccgtccgagtacgagggcaattgaagaaacttccatggcgacagtttcaacaccggcatcccgcatggccgctagagtccgttgcgttgtgatggcgtcgggggtggtgttggcagttggcagtttttcatccttgattttgcgatacatggtcccaatcaggccggtggcttgctgctgatcacgatagatttgttcgatcaggtgggtgacagtggtcttaccattggtacccgtcaccccaatcatccgcatcttttgactaggcgcaccgtagaaaacgtcggcaagaattgccatagcgcgttcggtgttttcaacgtagatgaccggtacgttgacgtctaaaggttttgacgccacgatgatcttggccccttttccgatggcctgatcaacgaggtcgtgaccgtcgacgtgataaccaacgacggcaataaacatggcgccgggctgaacttcgcgggtatcctgcgtcagcatggtgacatcaaagtccgtggtcaaggcgggctgaacctgcttgaattttaaactattaattaattgacttgcttgcataatattagcgtccttttcaataaagttactgtttctagaatacatgcaaaccggataattgtcaccccaaatgagaattgaaattatgcttgtaatcgctcggtacatggtgtgctgctggttgaacgtgccatctccaggccaatctaggtcaacaaaaaagcccggcaattaagccggacttgcagggatggttattcgattcctaagaactcatcatgtaaggcgttcatggccgcttttaaatcggcttccttaacgagcacccagatggtcgtataactatcggtcgattgtaaaatatcgatatgttgtgcagctaatgccgagacgatccgagcagtgacgccgggtgtcccagtgataccagcaccgacaacggaaactttagcacagttcgcaattgactgacaatggacgtgcgcgtcagtcagtagctgcttggcaacgtccgcgtcaccatcaaccaggttgaagacaacttggtgtggtgtaatgttaataaagtcaacactcaaaccgtgctgtgccatcaattggaaaatggcacttgaacttaacgtatcggtaggaacagtaaattgcgtcaaatcagtttggtgtgcaatccctgtcacagtacgataatgttcgatttgggtcgtggtccggtcagtgactaaagtccctaattcgtcgggttcctgataagttgaccgaatccgcatcggcacgtgagcttgttctgcaatttcaacagcacgcggatgaatgaccttagcaccttcatgggccatgttagcaagttcttcgtagctgatggccttaatgaagcgggcgtgggtgacgagtcgtggatcggcagtcatcatgccgttgacatcagtaaaaatatcaacacgttttgcttttaaagcggcgccgaggatggctgctgatgtatcggaaccaccacggccaatcgtagtaatgtggccgctctcagtagcaccttgaaaaccagttacgactaccacgtcggcgtcaataaaggcgtccgtgattggtttcggatcaacgcggagaatcttcgcattttgaaaatcgtcgttagtcacgatgccagcatcatgaccagtcatggccgtgacgtttaggccttgcttacgcgctaactcggtaaagacagcggtcgagatggtttccccaactgagaccaacatgtcgagttctcgattggttaagcgggagtgctcggccccaactaatccgagtaatgagtcggtggcgtaaggggcacctttccggccaattgctgagacaacggcaatgactttatcgccctgatcgacggcgtattgaacgtgctttaaagcttgaatacgggcggcttcgtccttgactgacgtgccgccgaacttttgaacaataatttccattgatctaaaactcctcgactttttccgcaacggcgttagcttcggggctatccatcaagtggtcagattcgacatagagtcggtgccacatcatgaaggtgaggaccgtccagagtttccgagaattatcccgaacgccggccttgtggtcatctaagagtttcaagaagtagtccttattgaagtattggtcagtttgcgaatcgttaatgatctgcttagcccagtcgtacatttcatctttgagccagaaccgaattggtactgggaaaccaagctttttacggtgaaggacgtgcgctggcacgatgtcttcgaccgctttacgaagaatgtactttgttgtgccgtgactaattcgaagatcagctggaatttcggctgctaagttatacacttcacggtcaacaaacggggtccgcagttccaaactgtgcgccatcgttgtccggtcggcgttatgcaacaagtcaccgtttaaccacgtgtgcatatcgatgaattgcatccgactgattggatcatagtcgacggattcatcatagagcggttgcgtgatggactggaacggatggttctgattgtaattcttgaagaaggcttgtttttcttgttcaccaaagataaaggcgttcccaacatagcgattttctaatggggtggtccctcgtagtaagaatgaccgaccacgcattccctctggcatcatgagtgcgatacgcttcaaggcaccattaatcggtttcgtgtagcggaacggtttcaatgattctggttcatgatagatggtgtagccaccgaagagttcgtcagcgccttcacctgtcaaacaaaccttaacgtgtttgaccgcttctttggctaagaaatactgcggcacagcggccgggtcagccaacggatcatccatgctccacacaaagtgcgggaaggccttcatgaaggcttcaggcgtaatcgtcatgctgtaattcttaacaccaagcttttcagcggtctcttgagcaacgtcaagttcactatacccttcacgttcgaaaccaacggagatcgtttcaaggtttgggttgaagttttttgcaatcgcgacgatgattgatgagtcgatcccgcctgaaaggaaagaaccaactggtacatcggaacgcatgtgaatcttaacggagtcaattaaggcatctttgatttttttggcatactcgtcttcagaacgttggaccggatggaattcacggtgataataccgatcgatccgtggcgcagaccccaactttttcgtcaaggagcaaccaggggcgagcattttgatttcttttgtgagtgtttctggttcaggaacaaattggaacgtcatgtaatcttgtaaggcatttttatcgaaggttttatcctttaaaatcttgtaaatggccttgctttcggaagcataatagaagtcatcaccactgatagcgtaatagaacggcttgatcccgaactgatcgcgcgcggcaaataacgttttttcttgtttatcccagatgacgaaagcaaacattccccgtaagtacttcgttgcgtcagcgtggtacttggcgtacatcgcaagaattacttcagaatcggagcttgttttgaattcatagccttcttgtttgagttgttcacgtaattcaacgtagttataaatttccccgttaaatgtcatccagtaacgttcattatcataagatagtggttggtgaccaccggctaagtcaatgatacttaagcgccgaaaacccatggtaatgttgtcatcagcaaaataaccgtcatcatcgggtccccgatggacaatcattttagtcatttcgtggatggtctgatcgtaagctgcgttatccgctttagtccgatcagttaagcaaccagcaaaaccgcacatgtctgttcatctctcaatctttaaagtttagacagttcttatctactatatgtgtacagatggttcgttgttaatttacccgtttcattcacggatgtaaagcactctgaacaattataacggtttcttaccaatgtctgtcataattatgcttgacaatccgcgacgtacactttgactattatacttgctttaattcataagataaagcggagcgcgcagatggaacgctttcattgataaaaatttcatattgcgtgaaacgtccaattagttggatgccggtttattggcagagcggatttctactgactatttaggtagttcgaattgaccgttattgacatgacacatttagatgctgattgccggccttatggctgaaaaagtcacagaaaaatcccgcaaactcatgcacaaatttgcgggacgtttaagtaggaatattaaattagatgtgaccttgcgctctaagcccagccaactaggcgtaatacggccatggcaacgatgcctgtgataacgacggctagtaaacttttggtgagcactcctgcaagaatggcaggaattgaggcataaatatttgggagattaaattctggccagtgtcccgcatggtaggtgagcagactttccacaaaaatagcggtcataatggcaactggcacaaatgataaaaagctgattagccattgggggactgacagatttttaatgatggcaaacgggacaatgcgtgatagccaagtcacgaggccgcagagtaagatggtcacaaaaatgtaagtactcatttgtggtccaccaccattccaaaaccgcaaccgagtagcgtcgcaaagatcaaagccaagttgcccggaacccaacgcatgagaaaatacatggcgagggccacaaatagtacgacccacaactgggtcggcaatgatttactgcgatccgtgatgatctgcaagtaaagtaaaccaatgaacataccaacaacggcaaaatccaagccgaactggttagggtcagtaatcaagttacctaaaaggcaccccaccactgtcgcggctgcccaaactaagtaagccacaatgttagcagcgtgtaaccaactcgtttttaattgttgattggtctgattgagcttgttcatgctgagcgcgaaggtctcatcagttagtaacgatcccagtccgatattttgcaataacgactcttttttgaaatattgagcgattgacatgctcattaaaatcatgcgtgaattaatcaaaaaagtggataagacgattgccgaaatcggactacctgctaggagcatactgacgataataaattgtgcggaaccagcatagacgattagtgacatgagcagaacggcccaaactgataggtgactcgtgttggcgacaatgcccattgctaggccaacgccaatgtatccaaagacggtgggaatgacatccttgatgcccgcgcgaaaggttaaactagaatccataaatgtacgacctccgattcaataagtatgcgttaaccaacactaaatgggattatctgacaattagtgtggttcatgaaacaggataactatgtaggttaagtttgagtgcgtgttatgatgaaaaagcacgcttgatatccgccaatagtaaggtgacgaatgaggcaaaggcgggttaagaattagtttactactttcggtgaaaataatgaagaaaattatcattgacttttaatcgtgacgttacgaaattgttgcttgcatttcaaaagctgggggcgtaacataatcacattgattttttgaaaggacaaatggtgagagaaaatgactctggaacaattagcagcccatagcggggtcgctgctgataaaatcgtcgcctataccaatgccgggttattaccttgcaaggatgtcaacgcgcattttagcgccgatgatgaatattggctagatatggtcaattgcttcttagaaaatggctcatccgtcgaggatttgaaagatttaatgccactttgtgaacagtgtgcagctcaataaataagtaagttaagacaatcgcaccgattctactagaattggtgcgattgtttttttattactcatcgttattaaacaatcatgattaaaacgtgccgattcttaagttcaaaagcagccagcttagacccgctgggaaaagttcaagttagcgtaaatatgcttagattggttcgtcctatatcgacctccaggcatttctgccnnnnnnnnnntcacccagccccggaggtcgacataggacgtgcaccggctgacgaacaggaatccacctaatcggcacggtttaatcataattagtcctgattggtgttttggagcggacactattttttaaatgttcaatcggaatataaattaatttatatgggctagcaggattgagggactaacggtatacttattgaagcataaataccaaccaaaaaggatagtgaagcagggatgaaatcggggaagcaccgggtatcattattgatactgttatgtttgatggtggtcggtttagctggctgccataacaaggcgtattcgcagtcaatcgagaaggggttaaatgcggttgctgagaataaataccaaaaagcgctgacgtattttgataacgcgctagcgcagaagcccaaggatgaaaaggcacaggcgtaccgggatcaaacgcaggcctacttgacgaccacatcggagttgaaggccggaaaagttaaaacggcgctgacgacggttgataagggtgtcaagattacgaacggggcaacaagtttgacgaataagctgaaacagttgaaagtcaccgtaaccagtgattatcaggaatatcagcaattgtcagatgatgttaaagcacagttaaaggtgaagaacggcaactattcagcggacgtgctcaaacgttgcgcagccatcaactgggataaaaagccatatttgaaaccgttgaaggctaaggtaaaacagttattgactgcggcaaaaaaggccaagacgaatatgaaagttagtgcggctgaagcgaaacgagcagcggcgttacgtcggaagattgctgccgctaaaaacaagtggaacatggccgcattagacgatgtgcccgattggttcattttggcactttttgccgacgatagtgatgtggatgatgctgctgaagaattagatgacgaatatgccgatcaggccgacgataatgacgattattcggatcgggatgagcaaacgactgattcgaatgatgacacgaacgacaccgacgcggattcggctgatgacgattggagtgatcaagatacggattcgaatgacgataccgacgatgattccgatactaatagcgatgctgacagcgattcggattactcagaagatgatgacgatgaagattcgaatcgtgatgacgccgatgacagcgaaacccaatccgatgacgattacgatgatgatactgatagtgagtctgatgacgacgattatgatactgatgatcaatatgacgatgatgatgactacgatgacgccgagagcctactcaacccggcacctgttcaaccgtcagtggccgaccggctgtttgcgtcggctagttgttagtcgttcagcggtaaaatcaccaaagatcgtctgacagttttaataatgcagttatgggcgatataaaaacaagcgtccgcgttgattagatcaacgcggacgcttgttttcttacgtggagtttgttgccgaacatgtctgagtaccagttgctcacgggcaagcctttatcttagcgttgattaaggctgatgtttaaagcgagcgtaaatcgagctcattgttgaaaatccgatgactattaagaccatgatttgtaatacgccagtggggtgctgaatttgcctgacgataatgtaagtcagaatagccaagttgatcagccaaccaaatcgtcttatttgcttaattataaaatttttagggtctgttttactaagcatataaagtaaaagggcgatgatgatccaaaacaatcctgatgttgagtgatagtacacgtaatcattcctttagacgtctgactttctaatgacatcgtaacaatcaacttggtacgtgataatcgtatcatttgctcgaaagcatcaaaatcatgttttagtaaagatagtgtacattttcagaaaagaaacgtgaattttttgtaaaccaccggcataattaaccggcgcatcgattttgaataagtgtggtcttgacgctggggcgccggcgctagttttggcaagacgttagtgaaagggggggacaagccatgatgatctttagacaacaaagaccccggcatgccggggtcttgtcagctatttttaattgttagttcaagttatttgctagctttaacggttttaagcatgctctgaatggcattggcttgatattgagcagccgctgctttttgaacttttgcgagttgcgctttgctcattgtcgggttcttgaccattgcggccttgacctgattagtcacgtagactttagcacgcgcttttaatgtcgcttgctgttgcttcatcaatttactgaattgtttagcttgggttgtgctaagtacgacccagttcttattgatatagaagtagttggttcgcttgatcaactgtttgtcattgttggctaagccaaaccagaacttcatggcgttactcttataagtccaccgtgtcgtcttagtaactaacttaggtgtcgcggtcgtcgtcttaacttggttagcagtcttgacgctggctgtcgtatggctaacttttttctgattagtggtctttttataaatatagacccggtgcttgtcagcggtacccacactttgatagagcaataaatcaagttgcttgctactaccagcagactttaatgattgcgtggtggtcgtcgttgttttgaccatcccgtaatgttgaccatcattcttggagacgaagacgatcgaggtcactaagagtgccgcaaagataacggataggctgattcgtaatgtgttttggtgaacgtagataaatgataagaagagcgcgattgcgctaacaacgagtagtacgagaatcattagtcgttcacctccttagtgttcattactggcttaacggaatgctgcttgcctttcatgaagaacgcgacgacgagcccgacaactgagaagcccacggcaacccagaaagccgcgtggtaaccatttaaggttgcgttgaaatagctgttctgataaccaagtggattgctcttaatcaagctatgagctggttttgtggcgtccgtaacgtttgataagacggaagtcaagatggcagtcccaatggaactagcgatttgacgcgtcgtgttgttaacggcagtcccatgacccattagttcaacgggaagggcgttcatcccagcggtagttgccggcatcatgaccatggcaatcccaaacatccgaacggcatagagaaccacgatgtaaaccgttgcggtattacgagtaatgaaggcaaatggaatggtcccgattgtcagtaaaaacatccctaaaattgccaagcgtttggcaccaaaacggtcaaaggcccggccggtaattggactcataacccccatcattagggcaccagctaatagtgatagcccagattcaaaggcggagaaaccatgaataatttgcaggtaaagtggaataaccatttcggcccctaccatggccatgttagcaactgagctcaaaatagctgcaattgtgaactcggcatgcttgaagacccgtaattggaggaatggattttccatcgtcaattgacgccaaataaaaccaatgatgaagataacaccaataattaaagttgagagaaccacggttgacgtccagccattgtcaccaacggatgaaaagccgtatagtaagctcccaaaaccaatggtagaaagtaccaaggatgcaaagtctaattttggcttagacgtttccaagacgttggccatgaagaagaagccagcgattagaacgattgcgacgattggaacgatcaaaccaaataaatcgagagcgtaaaatatcttgnnnnnnnnnncaagattcttgacgctaccaataaatcacgccatgataagttgtcgataacccacccagataaggttggaccgatggctggggccaaaccgataacaattccggcagtccccatggcagccccacgcttatcagcagggaagatagatagcataatcgtttgaagtaatggcatggtgaccccgaccccaacggcttggatcaaacgcccagccaataagaagccaaagtttggtgctgtccaacagataatagtacccacttcgaaaatggccattgcggaaagatataaccatttagtggaaatccgtgaacttaaccacgcactaacgggaatcataatcccgttgactaacataaacccggttgttaaccattgcacggtcgacgttgtgatgtcgaaatctttcatcaacgttgggaaggcagtggttaaaatcgtttgattaagaacggtacaaaaagtaccaactaataaaactgcaatgagcaagccacggttataaggcttcccatgcgtatcaacaggagttgacaagtaaatcccttctctctaaaaaagtacgttgtctaatataatcggatttatcgactttgtcaacaaacttgacattaatattaaaaataatatactgagtattgaaaatgttagaaaagaggttgacccgtggataagcaagaagacggtgtattttttaagaaatttaaagaacagctgggtaagcatcaattcacaatcggaattagcgatttggcgaagatgaccggcgtctctcagacacagctacgttactgggaacagaaaaattatattcatagtcttaaagtgagtgagaagaataccacgcatcgttattcgtatggtatgctgatgcgtgttcattttatcaagatgatgttagacgagggttttacactggcagcggctgtcgagcgggccgatgggtataataaccaaatggaaatgatgcgcatctttatgatgacggcttttcaaggaatcgaagaacgggatggtcaccacatggtcaagttgggatattttgacgaagcgaagacacaacagctttattgttatattcaagatgagacgccacattatcgactttatcccgttaagtcagagcgctagcaaccttcagcttgtgtaaccgattaattaatgttaaatttaagttggtaaatgtcggtaagtcacttgggcatttaagtttcccgttcgtcaaccgatcttatggctgggttgaccgttgtcatgttggtcgtgttttgaagtttaactttgcaaaaggatttacaacggagcgcgaataagcgctgagagatgcctagctagaactaggtagtaatcgtgcataaaacaacgtgtaattgaaactagtagtagtcttcaatcgcccggtgatgatatttaccagaggtcccaagtgctgcgggaaagcttggggcttttttgtactttcgtacgttaaaacgtaatctatcagtgtggttatcaacaaaaaagagaccgagtatcaactcaatctctttaaataatctataagtacgcgtggtgcttgtctttcatttagtattaattctacttctatatgaaataatcacgagtagcgcgcgttaattaagtaggaattgttaagatgtcgcagtttgagcaaacttggcggctaaccattcattccatggtagtgctggattaccactagtaaagtattgttgatcgagtcgatcaatcaagttgacgtaggcggtaaatgaaaaactaacggtgtcactcaagcgctgagccttggtcatgtagcggccgtaagtaaggtgttcattgatgtctgtcatatagctggcaacatcatagttggacatcatttcaaggttgttagcgtcaaaaagtggtaagtagaatgcggcaaagtcttcaactgccttgtgctgcaaagaactatccaattgcgtaattgataattgagcatcatcattcacgatgcggttcctccttagttgaacaagcacgtttctaaattagtaaccaaattggttattttgcgctacaattaattatgtcacgattaggcaattatttcaaagctttgtcgttattagagactagaactggtgtctcaattgtagtaagatgttagaattatattagagagaatcagaagtaactatttagttgaggtgaagaatattcatgacccccatgaaggaagattacttaaaaattattttcgagcttggtggtacgaaaaaaaaggtgtcgaataagcaaattgccttaagtttagacatcgcggccggctctgtaacggagatggtcggtaaattagttcaggaaggcttggctaagcataccccgtatgctgggatttcgttaacaaagaaaggcattcgctacgctgaaacgttagttcgcaagcaccgaatctgggaagatttcttagttgataaattggattatgatttgccagacgtgcatacggaagcggaagtgctggagcatgtgaccagtgaacgactagtggattctttggaagcctttttaggcaatccgacgcattgcccgcatggtggcgcgattcccgataaggatggtcattatcaggaagacagtcatgtgagtttagcagatacgcaggatggcacaacggttacgattgagcgatttattgataatcatgatttattagtttatttgcatgatacaccgctcaagattggacagcaggtcacggttttaaagcacgatccatttgaaggtcctgttaccgtttccattcagaaaacgggcgaggaaatcccagttagctataaagcggcgcacaatgtctttgtaaagtaagcatgcggcacctatttccgaacaaacctgttaattgttagttagttattctgtttcatttatcatcacataaacatttcatggaaatcatggtgtttggctaccctttttagaaacaatatgctacaattgttcttgtagcttggttaggtaattttggtcagatcgtttcaataaactatccccatttgtaccgaatcatgatttacattattttatacgtgcaaaatgcactaggaggattttttattatggaacacggaacagttaaatggttcaacgctgataagggttttggttttatcactcgcgaaaacggtagcgatgtattcgtacatttctcagctatccaagaagacggcttcaagagtcttgatgaaggccaagctgtaaacttcgacgttgaagaaagcgatcgtggcccacaagcagttaacgttacaaaagcataattaacagcttaaatggcttaaaccggtgatgagaattaattctcatcaccggtttttttgtcgttttgcagcggatgcttaattatcgtaaataaggctttactaacagccagacattggctaaagtaagaatcattagagaatgtaattctgattattaaagggtgggatgacagtgacaaccgatgagatgattattgcgacttgcttgaaggctggtaaaatcatggtcgagaatggttcggagatttcgcgagtagatgatacgatgatgcggattgctcagaatgcgggggttgttgctgccaatacctacgtgacgattacgggtgtcatgatgtcgattcaaggacgtaatgcaacgcagattgccgcggttaaccagcgaacgatcgatcttgaaaaagtggcacaggtcaatcagttatcccgtgaatttgcggctacgaccattgatttaccaactttatatcaacggcttaatcagttagatgcagcttcgcgctcatttccgttgtggttgcagttggtcggtgcagccttagtcagtggccccttgatgattatgtttcgtcaggaaattgttaatacgtggccaactgttattattggaacattaggttacttggtcttttatctgcttaaccggtatcttaaaattaaatttttgagcgagttaacggcggcacttctaattgggtttggcgcggaatgggtgtgtcagattgggtggggaaccaatgtcaatgatattattatcgggtcgttgatgccactagtgcccggagtgccattaacaaacgccgtacgagatactctggctggtaatttcgtcagtgggcctgcacgtggcgtggaagcgatgctgagtgcggcagcactaggctttgggatcgccgttgtcattacattattttaagtacgggcactagcctgggtattcggaggaatcatgatgggcacaattggacaattagtgctggcttacattgcggtactggggtttggcctgattattaatattccacatcaagcgttaaacgttgcgggctggattggtaccctaacgtggggtggctatttgattgttcaggcttttgatggtggggtcgtcttaggaagcttaattggctcggtcggtattggcgtcctcagcagcttagcagctcgctacaagaagatgcccgctattatcttcaatattccgagtttagtttcattcgtgcccggcagtcaggcttatcagatggtgcgtaactttgcgctgggtaattatcgtgaggcggtttcattcacgttgcaagtgattatgattactggtgcgattgcattgggattcttattagctgaattactcaaccggcttatcgcattttgtattcgccagtggcggttgcaccgattggagtcgtaacctaactgttggctgattagttgtgaatcgtgaacaaagtttgcggacgctaagactaagcgccataaataaattccgccaaaagtggtgggttagtgcgactaatttgccgtgtgccagcgttctgaatagttacgcgcttagattagttattacgactcgcattcaatacagaaaaaggcgccaactgaactgctctactaagcagttcagttggcgccctttttaattagttagctgagacatcgcaacaagtagtcacgactcttatcatcaaatcagatggttagttttggttagcaaatttttcgccggttgtcgcagcctttaaattaagggacttacgtaagacgttcgtgacccgttgcttttcagattgcgaaacaacttcgaaagactgaccatcaatcatcttaccagtaccctgggcgtgatcagagacgatattcttggttgcactacggtaattagtgacgatactagttaaattaccgaatgttaagtcagtccgtgtttgtttagcaagtgaatttaagaaatcttgtttaagcaagttggaagcactggcgctttctccgataatggcggtaattaattgccgttgccgctgttgccgaccatagtcgccgagtggatcatcataacgcatccgggagtaagccaaggctttggcaccattcatatgttctttttggcccttagtaaaggtgtagccttcgtaggtaaatgtccgaattggagtaatgtcaacgccaccgatttcatccacaacttttttcatgccacccatgttgatcagggcgtaatagtcgattggaacgttcaaccatttttgaacggtcttgatggtcgttccggcactaccataagcgtaggcagcgtttaacttagtcgggaagtcctgttcgaagccggagacagctacttcagaatcacgtggtaaactcatcagggtcgttgtcttagtcttggggttgatcgttgctaagatgatcgtatcggtccggcctttatagttccgcccgagggccccggtatcagttccgagtaataggatcgagacgggtttcttgccattcaatacggcgctcgtattccgactctttttaataccactactcttgaagacggtgtcggccgcattcttggcgttaaaataagttcgcgcggcaaaggccccggtcccaactaataacacggcaataatgattaaaacggtattgcgaacggggtgcttcttcttgggcccgttgccgttcccctgtgaattgtttccttgtgatttctcacgatgcatttctgagcgacttggcatgtcttccatgaactcttcctccaatggtaatagttattcatagtttagcattttttcgggtcagcgggaactgaatccacgtaagatttagcttgattaccgatgactgtcagataaatcataacctttttgttaataaaacgtgattaaaatgggaattctttgttttttttaaggttccctgagagatattaatgattcgttcagtcgattaatagactatggtataattttgttaattttaatattaaatgggggttcttgttttgatgatcgataagtcgcgtagtcggccgatcaagtttgtcattggggtaattttatttgcctacttaagctattttattagtgacggcgcggttggtattgatttactagatgtggccttaacgtcgctggtccaaattagtaatagcggtatttggacagtattttataaggtgattgcttggttggcgtcacccggaatggacattttgtggatcgtcatcctggcgtttctaatgtacggatttaaatataagattcaagcgttctggacgctagcatatatggttggttcaatggcgttaggctttattgtcaagcacatcatcggccgagcgcgaccaattggtcatttagcgcaggataccggatatagttatcccagtggtcacgttttaggaaccttcgtgttggtcagcgtgattatcatgttgattgttcctgagttgccaagttatcgaatggcaatgatcgtcaagtgggtgagtgtcgtatggttagtattggtcattttctcacgtatttacttgaatgcacattatccaactgatacgattggggccgtgctattggcatggtcttggagtcaaatcatgcaatggttctacgttttctgggcaccaggattattgaaatggccgttgttttatcgttcatatttataaagacaattaacaaacttaaactaatctattatttagcaggcaaccgtgtcactaaataatagactcaaaataaaaaatcgtttgctttaatcgacactactcggctgattgcgagaaattgatcgaagcaaacgattttttgtttacatctataaaatattaactagcaacgactggtaatgaactaacgattatcagctagccattcaagtgctaatgttaaccagtgggcgacgtgcggctgattggcgtctggtttccatgctgtttgtgcattcgcaagggctagtccgtgtgggccatgtttaaagacgtgtagttcataaggaatcttagcagttgctaacgcagtcgcgtaggcaagcgtattggttgctggaacaattgggtcgtcagccgttgtccagataaaagtcggctgattatctgaattgacgtgttggtcagcggccagttcattcggcgttggtgtccaggtagccaaggtcgcgtcatccttgggaaaacctagcaatggactgatgactggatagccgagtaccacgttattcggctttaacatggcgggcgttacgtttaattcagttgccacgcgggtcgcccagtaatcgttatacagtgccacaatgtgaccacccacgctaaaaccagcaggcgtgatctgttgcggatcaatatgccattcggccgcgtgttgacgaagcaagttgactgctcgtcctaaatctaatacgggtgctaatccgagtggttgttgatcagtgagtagcgtatattccaagtaaaaggcctggtaaccgtgcccagcgaaagccatggcgagactctctgcttgcgccactggaatatgcgtgtatgagccgcccgggacgataataatggcgggtaagttcgtttggtgtgcgttcgtatccggttgatgcaaataaccggtcaattgcgcgcacgtcgctgttaatttttgcttaataacttgcatgcaatcacctcaatttgatatggttaacataactattataacgcaagtcaggtggaacagatatgggcatggttacggttacaactcggaatgagcaactcgagttacggccatttacgttggcagatacagaggattattatgacttagttcgtgatccgtcaattgcggcatcggcgggctttacgccagcgcacagcttagtggaagccgaattcttattgaaacaacaagcgaagttaccacagatttttgcgattgaactaacagcgatccaccgcgtaattggcagtgtgggtttgtatgagcgcatgacgaatacgggcgaaccagcaactttagagatggatctcgggtatatgttgaacgctcgatattgggggcggggcattatgacggcagcagtcgcacgtattttacgatacgggtttgaaacgcttcatttgcggcggatcacagccagttgtttagccaataatccggcgtctaagcgaatcttagaacatgctaattttcgacagtatgatgctgttcgccatccagattacgccccgtttggcgctggccagacggagttattctttgattgtgtggaattaaacctttaggagatgagttaatgcaactcgcaaaatcgtttgaacaggccgcctgcgtgttggtattgttggctacgcagcaacctgagattccgttgactgcggatgtcttgcacgagcgaattggtggttccgcttcgtatattcgtaagattattcgtaaattagtagtggcaggactggtcacgtctaccagtggaaataacgggggtgtccacttggcacgttcacctgaggatatttcaattacagatgtggtcgcggccatcgaggggacgttgcagacctttccgaattatggttattttgaccgagtatttaaggacgttgaaccggtcgctcacgaagggacgaaagtggtcaacgggattttttcgcgagcggatcaattatggttagattttttaaaccagcaaaaactggcgacgttgatcaaggaattattagctgttactcaaattccagtgttggattggacgaattattcagatgataaaatggcccaattaaatgcattgcttagtcggatgcgggcgcataagtgagacggcgtacaaactcgataaaaattgggagcggtttcgcttggtaaaccaatattgacgcgcttttgccaatcggggatcattttcaaaatgatacactttatttcacaaggctgaaaatgctgttattaaagcgttttttatggtattctaacaatgaatttcacaagatagaggggaacaacatgccagataagaaatattacggggccgatgcgatcgtcgacagccttgtaaaccacgacgttaagtacgtattcgggattccaggcgctaagatcgatcgggtctttgagcgcttggagcacccagtcaacccgaaaagtccgcggttgatcgtgacgcggcatgaacagaatgccgcgtttatcgctgccggaatcggtcggattactgggaaacctggtgtagtgatgacaacatctggtcccggtgccagcaatttagccacggggctcgtaacggcaactgctgaaggtgacccagtcttggcaatttctggtcaagttcagcgtgctgacttgttacggttgacccaccaaagtatgaataacgcggcactgtttaagccgattacaaagtacagtgcggaagttcaagaaccggaaaacatttcggaagtgctcgcaaacgcttaccaggaagccacagctgctaagcagggtgccagctttgtcagtgtgccgcaagatgtcactgattcgattgtacgcacacctgttattacaccaatccaggcacctaagttaggtcctgctagcccggtcgaagccacgttattagcacaaaaaatcaaagcagctaagttgccggtcttgctagttgggatgcgggcttcttcaccagaagtgacgaaagcaattcggaacttggtggctgctgctaatctaccagttgtcgagactttccaagcggccggcgtgatttcacgtgatttggaagccaaccatttcttcggtcgggtcgggttattccgtaaccaaccaggggatatgttactaaagaagtccgacttagtgattgcggtcggttatgacccgattgaatatgaaccccgcaactggaatgcggaaggcaaatcccgtatcgtggttatcgatgcaatgcgcgctgaaattgatcataatttccaaccggaaaccgaattgatcggtgatattgcccagacgttagactttttgttgccgtacatgaagggctatgatattagcgatagtgcgcgagcttacttgggtgaattacaagaacggcttcagacgcgtgatttcgtacctaatattgataagcagtccaagttaaatcatccgctgtcagtaattgcagccttacaacaacgggtcagtgatgacatgacagtgacggtcgatgtcggcagtcattatatctggatggcgcgtcactttcggagctatgaaccacggcacttgttgttcagtaatgggatgcaaacgctaggggtggccttaccttgggcaatcgcagcggctttggttcgtccagatacgcaaatcgtgtctgtctctggtgatggtggtttcctattttccgcccaagagctggaaacggctgttcgactgaagcaaaatatcgttcatttgatctggaatgatggcacctacgatatggttaaattccaagaagaaatgaagtatggcgaggatgcagcggtccactttggcccagttgattttgtgaagtatgctgaaagctttggtgcgactggcttgcgggtaaaccaacctgctgatttggaaaaagtgcttgatcaggcctttgccacggatggtccagttgtggtggatattccaattgattattctgataacaaagcgttaggcaagacaatgttaccagaccagttttattaaaattaacattagtgaccggttgtcaaaagatggtcggtcagatataatagttgagtatatcgaaagaagaggatgcggttaacaatagtagccggctggaagtgggtcaccacttatgaaggtcagtgaacggggcaaccgccgaaatcgatggatcagtgaccgattcatccgttgggccttggttgaataaatcatggactgtcgcagctagaatagttgcggggcgctatcgacgatgaaatcagcaattatgtcaatcaatctgattaaagtctttttgcgcacgttatcgtgaggcaaagaggctttttattttgattgtgctaacctgaatcggtgtgaacacttttagatataaatcgatttttggaggttctgcaatggcagaaaaacaacatcaggaagtgcatcgttccttacagacgcggcatttatccatgattgcattaggtggtagtatcgggaccgggctgtttgttgcgtccggttcggcaatttcaacggctgggccagggggagcattactggcctacgttggtattggagtgatggtttactttttaatgactagtctgggcgaaatggcaacttatttgcccgtttcaggttcgttttccacgtatgccacgaagtttgttgacccggcacttgggtttgcgatgggctggaattactggttcaactgggcaatcacgttagcggtcgatattagtacggcggcgattgtcatgcagttctggttgccatccgtgccggggtgggtttttagtctgattgcgctcgtcttgatttttacgatcaatgcgctgtcagtccggtcgtttggagaaactgagtactggctttcgctaattaaagtggtaaccgtgctcgtattcttggttatcggtgtcttgacgatcgtgggaatcatgggcggtcatgccactggcctcagtaactttacctataaaaaggcaccatttgtcggtggaattccaacgattttgagtgtcttcgtggtcgctggtttttcgtttcaaggaaccgaattaattgggatcacggccggggagtcagcaacaccggagaaaagtattccggcggctattaaacaagttttctggcgtattttgttattttacattttagccattttcgtgattgcggcgattattccttatacgtcgaaagatcttctagggtcatcagcgagcgatattgccatcagtccgtttacgttagtctttaaacgggctgggttggcggctgcggccagtgtgatgaacgcagtgatcttgacgtccgtattgtcagctgctaattcggggatgtacgcctcgacacggatgttatattctttgtcattacagggttatgcccccaagacatttggtctggtcaatcgtcgtgggattccaatcatggcattattaggaacgacggtgatcggattactcacgttcttgtcgagtctattcggtgaacgaatttatattttcctcgtttcggccagtgggttaacgggctttatcgcttggctaggaatcgctatttcgcatctgcgtttccgtcgcgcgtttgttaagcagggtcatcaattgagtgaattgcggtaccatgccaagtggttcccatttggcccgtggttcgcctttatcttgtgtgtcgtggtcattattggtcaagacttacattcatttgcaacgcttgattggcaggctattggggtgacctatatgagcatcccgttattcatcatcttgtatgtctattataagattcgctatcatactaagatgattccgctagacaaggttgatttgacacgcaaacgacatcatcaagattaagcacgcactttgatagtttgagtaaatgcggttgacactgggtcaatcgcattttttgacggcgagagttggacctgtcaactcaaggcgcggtcgtatttttaggtgtcctgatttatgctgataacactgctcgcaacagatggtcacggcggatcgttatgaatgggggcttgcacgattgtaatgatagcaagcggcaaattgagggtgcgctaatctgatatctatggtaatttgatagaatgagaatatggaatcattaaaaattcgcaaacttatccttaagaataggctagtcggctatgactatgctaagctgaaatgagaaaggcagcgagagagatgttaaagagaaatttgttaagaggtctagcattagtgtcattagcaggtgtcctggctggctgtggtgctagccagtcgacgtctaaagcgactagtagttctacgagtgctaagtcgacgaagacgcagaccaagcggcaacgactgattagtgccttaccgaaaggcgttaaatcgaccgatagcgacttagtggtcgtcaataagtggcataagcgcgctgagatgacatttaataagtcaagcgtggatggtattgaagtccgtagttctatcgtcaaaccattggaagcctttctagcgggggcaaaaaaagccggctatccagcaacaatcgtgtctgggtatcgttcagttgcttatcaaaaagaggtttggaatcagtcgattcaaacctatgagaatcaaggaaaatcagccaaggaagccttaaagctgactaaagaatatgtcgcagttcctagtggtagtgagcatgaaactggtctcgcagcagatatcatgaacacgcactggtacagcactcatggtaatcaattattgtcatcatccgacaagaacaagggtcagcagtggttgattaatcacgcggcggactatggatttgtgttgcgctttactaaagatggtaagcagtcgaccgggattgactatgaatcttggcatttccgttacgttggtaaggcgagtgcggaattcatgactaagcacaatttgactctcgaacagtacgtcagcttgctgcaagctcgagaaaaggcggccaagtaataagctagccgtattattgatggccccaattaataccatttatggcgtacgttaggaattagctagcgtgcgcttttaaattgtcttcggtttagcaatgtgggttcgtctcaactgagtattatttggtcatgacacgttgtcacttgattatgctggtcagaggccgcactcaaagctgaagtgccaccagcgccggcttgggtaacccagtgtgtgttagtgagttgcttggatcgctgactagtgcgtcgcagttgtggctggtgcgaagttttttactgaattgactcaccagatattgcattttaagacgtgggtgcgtacaatatgtagtgttgcatttagagataatcaaaattttgacgtgattaaaaggagagacgccccatgcttgtaatgtcaggaacaatcggtgccggcaagacgagtttaacgcagttagtggctaaccactttggttctaaagcgttttacgagtcagttgatgataatcccattttgccgttattttataaggatcctaagaagtacgccttcttattacaaatctattttttaaataaacggttagacagtattaaatcagcttttgctaacgatctggacgtcttagaccggtcgatttttgaagattcattattatttcatttgaatggtgatcttggccgggcgacgaataccgaagttgacatttatgattcattattagataacatgatgcaggaattgccagaagcgtctcatcaaaagagtcctgatttacttattcatatcaatatttcttttgatacgatgctcaaacgaatccaaaagcggggccgttcttacgaacaaattgatcaagatcctgatttatataaatattatcagactttgaatgaacgctatgacgactggtacgctaattatgatcatagcccgaagatgcagatcgacggggatcagctggactttgtcgccgatgcggatgcgcgtaaggaagtcattcggttgatcgacgaaaaagtggctagtttaggctagttgcctttttagaatcaatgttttatagtagacagtgaatattaaacacggcgcgtttttaagtagacgttcagagaaccggtgggtggtgtgaatcggtagtcgaaactccggcgcgacaatgtgggcaggtaatactgcacggcacggccgttatccgtttaagggtgggattaatcatgatcctgaacttgggtggtaccgcgaatcgcagtctcttcgtcccaattgggaggagagactgtttttatttacgattaaaagtgaaaaggagacgtcgttatgttagatgttaaaatgattcgtcaaaatccagattttgtaaaagaacagcttggtcatcggggcgttgctgcgagtgacatcgatgatttattggccgctgatgaaaagcgtcgtgaattgatcgccaagagcgaacaattgaagtcgacgcgtaaccaagtttcaggcgaaatttcacagaagaagcggaacaaggaagacgctagtgccgaaattgcagaaatgcaaaaggttagcgccgatgtgaagacgttggatgaagaacggcggacagtcgatgcccaagttcaggatatggctgcacatttaccaaacatgccccatcccgacgtaccagttagcttgaaagaagaagatgccgttgaattacgtcgaatcgggacaccacggcattttgactttacgccgaaagcacattgggatatcggtgaagatttaggcatcttagactttgaacgcggtgctaaggtttctggtagtcgtttcttatactacgtgggcgatggtgctaaactggaacgcgccgtttacaactttttcttagaccagcacgaagctgaagggtatacggaagttttgccgccatacatggtcactgatgaatctatgtacggtaccggccaatttcctaagtttaaggaagacgctttccggattacgacgcaagatttgacgttgattccaacggccgaggtgccattagtcaactattatcgtgatgaagttattccagctgaaaaattaccagtttactttacggccttatcaccagccttccgtgaagaagctggtagtgctggtcgtgatacgaaaggcttgattcgcttacaccaattcaataaagttgaaatggttaagttcacgaaaccagaagattcatgggatgaattagagaagttgaccaacaatgccgaatcattgctaaagaaacttgggttaccatatcacgttattacgttaacgactggtgacatgagcttcacagctgccatgacacatgatttggaagtttggttcccagaacaagacaagtaccgggaaatctcgagttgttcaaattgtactgatttccaagctcggcgggcgcacattcaatatcgcgatgacgatggcaaattgcaattcgttcatactttgaacgggagtggcttagctgtcggtcggaccgttgcagctattttggaaaactatcaaaatgaagatgggacggttacgattccagatgtattagttccatatatgcacggtaagacgaagattgaaaaacaaggttaattgagatgaagttagcgaactcgcagtgatgcgagttcgctttttttgcataattaatgagtattaaagggaactgtcgattttaaaatgtgagtggaaataacggccgagttgactaaataattgcgggacgggcagaatgttgggacaacatttcaggcgcaaaagggcgaaaaagctggggttactgaaatttattcacctttttttgaaaatagggtttgctattttcggctaccgtgctataatatttcttgtcggaaaaatataacttgtttatccagtaaaaagtatatttatccatttatttgaaaaaagttgttgacaagtattcaacatgatgataaagttaaatagttgtcaaggcataccagtaagaactgtttgaaccggcaacaaggcatgattaacatcatgcgggtgtggcggaactggcagacgcgctagatttaggttctagtgtcttacgacgtgggggttcgagtcccttcacccgcacatgccgacttagctcagttggcagagcatctcactagtaatgaggaggtcggaggttcgaatcctctagtcggcatttacaatttaatagctttattatgcggaagtagttcagtggtagaacatcaccttgccatggtgggggtcgcgggttcgaatcccgtcttccgcttttaatttgccggggtggcggaattggcagacgcacaggacttaaaatcctgcggttagtgataaccgtaccggttcgatcccggtcctcggcattttaaataagcacccatagcgcaattggatagagtgtctgactacgaatcagaaggttgtaggttcgactcctactgggtgcattagtatcgggaaatagctcagcttggtagagcacctggtttgggaccagggggtcgcaggttcgaatcctgttttcccgatcgtttaacacagtcttagttaagtgctaaggctttttatttaattttctcgggaagtagctcagcttggtagagcactacgttcgggacgtaggggtcgcaggttcaaatcctgttttcccgattacggttaaaccaactaatccagtcatttggctggatttttttatggccttttttgtaagcagggatgtttcaacggtcagggacacttttgcgacgttactcactaagtcagccatgtgaagaatacggtggttgtgactcatgatcctgacaaggcaacagccactgttagtcatgagctcggagaaattagtctcagaactgctgttcatcgttgtgataccagtgcccgtcgcctgcaatgaggagtgactcaacttgacatattttaaataggtagttcaatgaatatggagacctaataatttaatcattatgaggttctaaacggttgaatcaattgaaagcaaacgttcggcgtgctatgctgtaacaaccgttaagcacatgctagtccgcggtttgggtgaaattctttgcttttttccattatcctcgtataataatagtcaatattagtcaaagataatgaaaagggtgaagcacatgcaaagtcaaaatatctcggatattattgaaaagtatttaaaaagtattttggcggactcggagcatgttgaaattcgacggtcagaaattgccgaccttttcaacgtggtaccctcacagattaattatgtgattaagacccggtttacgatccaaaatggttacttagttgaaagtaaacgtggcggtggtggttatattcgcattgagaaggttaatttggtcgatgatgctgatgtgttggacgccctcatacaggtgatcggcgattcaatcacacaacgagatgcttatgcggtcgtccaaagtttatacgaggacgacgtcttaaatcgtcgagaagcgcaattgattttagtggcgattgaccacgagacgttaggattaacggaccgggacttagaaaacagtctgcgggcccggataattatcggaatcttgaaccacttgcgttacgaaagctaaagaaagcgaggaatcgcaatggataacttatttacacctagtgccaaaagtgtgctggtactggcacaggaacaggccaaatatttcaagcatcaggcagttggtacggagcatttgctattagcattggccatcgaaaagaatggaattgctaataaggtgctacaacaatatgccgttagtgaagatgacattcgtgaagaaatcgaacggttcactggctatgggacgttgagcaatgttggcaaggatacttacttgccatattcaccaaaggccaaagaaattttgtccgttgccggtgatgaagcaaaacggctcggtgccaacaagattggaacggaacatttgttgttagcgatgctctctgatgaaagtatcctttcctcgcgaattttaatgaatttaaacttagatctaggtcagacgcgtaaagtcgttcttcgcaagctaggtgtcagtgacgccatgagtaagcgcaagggtaacgcggctaatcgcggtggcaagaagactgaaggaacgccaaccttggattctctggcgcgcgatttgacccaattagctagtgaacaagaaatggacccggtagtaggtcgttccaaggaagtcaaacgggtcattcagatcctgtcacggcggacgaagaataatccggtcttgattggtgaacctggggttgggaagactgcaatcgccgaaggtctagcccaaaagattgtggccggtgatgtgccaactgatatggcagataagcgtttgatgatgctcgatatgggatcgttagtcgctgggacaaagtatcgtggtgaattcgaagaccgcctgaaaaaagtgattgatgaaatttacaacgatggccatgtgatcttatttatcgatgaattgcataccttgattggtgccggtggtgctgaaggggctattgatgcctctaatattctgaaacccgcacttgcacgaggggaactccaaacgattggggcaaccactttaaatgagtatcaaaagtacattgaatctgacgctgcgttggaacggcgttttgcaacggtcatggtcaatgaaccgaccgaagacgaagccgttgaaatcttagatggactacggccacgctatgaagaacatcatcgggttacgattacggatgaagctgttgatcaagcagtcaagctatccagccggtatatcagtgatcgtttcttgcctgataaggccattgacttgatggatgaggcggcagctaaagtccgcatcgatcagatggatcaaccaacaaagctatccaagaaccaggacaagttagcgcaactgcgtgaggataaggaaacagcgatcgaagcacaagattttgaacaggccgctgatattcgtaagcaggagatgcaactgaagcaacgcctagatcgaatcgaagctgaccaagacgccgaagtgactgagggggcaacaccacactatgatttacaagtcacaggtgaggatattgctcaggtcgttgccgaatggaccggggttccgttaacgcaattgcaaaaatctgaaagtgaacgcttagttaacttggaaaagattttgcatgaacgggttgttggacagccagaagccgtatccgcagtggctcgtgctattcgccgtgcgcgcagcgggttgaaagatccgagtcggccaattggttcctttatgttcttaggaccaactggggttggtaagacggagctagcaaaagccttggcagcagcgatgttcgggtctgaagataatatgattcggatcgacatgtctgaatacatggaacgctattcgactagtcgtttgattggctcggcacctggttacgttggttatgacgagggcggtcagctgacagagaaggttcgccagaaaccatactcggtcgtgctatttgatgaagttgaaaaagctcatccggacgtctttaacattttgttacaagttttggatgacggctacttgacggattctaagggtcggaaggtagacttcagaaatacgattctgattatgacgtcgaaccttggggcaaccacacttcgtgatgaaaaatcagttggttttggtgcaactgataaggccaatgactacaatgcggttgctgcgacgattcgagcaacgttaaaacagacgttccgcccagaattcttaaaccggatcgacgaaacaatcgtcttccattcattgaataaggaagaattacacgaaatcgttaagttgatgtcacaagaaattgttgatcgagtggcccaacaaggtatcaagatcaaaatcactccggctgccattgacgtggttgcgaaggctggctttgaccctgagtacggagcacgaccaattcgacgggcattacagactgaaatcgaagatcggttgagtgaagaattattgaccggcgcgatcaaggtcgatgaccaagttacgattggtgctagcaagggtaccattacaattaatattaaaaaccagcctaaggcagatggtcgttcgaccgtttcctcaaagtaggcgcgattaaattaaagatgacgcttgaagtggtagtccacttcaggcgtcatcttttaggttcaatcggtattaagatgctacccactgaagtgaactgtaggatctgaggctggtggttcggtgctgattggtgtaaattataataggaaataaagtcaagaaagaagatgataacatggcgacacgagccgaacagatggcgaagacgcaccaggcgattttagacacagcccgggaactgtttttaagaaatgggtatgatgcgacaagtacgcgcgacattgcgaatgcgattggcattacgcagcccgcgctttatcaccattttaaagataaagaggtcatctttctggctgtcattacgacggtcggtgcggaaatcaaggctggcattgaagcgattcaagtccgtgcggattggtctccgttggatcaattaacagaagtctcgctattactaacgcataagcatccggctgatgtcttcacgttaattcattccagtttcaaagcattaacgcatgaacatattcgcgagttgggcggcatatttgttactgattatgtgaagccgattcaaaccgtttttgagcaacctgacatgcaactacatgtgggggtcacaccacagatggcgacgaatttctatatcaccagcttgagtccactgtttaacagttttcatcaaatcggtgatcctcatgctgacgagcggacccgcgttcaaactcttttaaagatgatcttatacggggttgcgagtgaaccagaaaactaatggcggcagagaagtctactagttgacaactaacgttattcgatgtatattataacttgtctgtaaccgtgaactcgagcgaacgcgcaatctattgtctgtgcggctcgttaatataaatccaaaaatagtcaacttaagcgactatttttggtttttttatgcctaaaattcggtcaaaaacgcatttgtaacacaaatgtaatatttggccggaggtggcgggttccggaataataagaaggggtgaacaacttggccggacatttagtaaaatacggtaaacaccgtacccgtagaagttatgcacgtatcaaggaagttcttgatttgcctaacttgatcgaaatccagaccgattcttaccaatggttcttggatgaaggtctccgggaaatgtttgaagatattatgccgatcgacgatttcgcaggaaaactttcacttgaatttgtcgactatcaattattagaaccaaagtacaccgtcgaagaagctcgtgaacatgatgccaactactcggcaccattgcacgttaccctacgtttaactaaccatgaaactggtgaaattaagtcgcaagacgtattcttcggtgattttccattaatgactgaacaagggacgtttattatcaacggtgccgaacgggtcattgtttcacaattggttcgttcacccggcgtttacttcaatgaggaattagataaaaatgggcgtcctagctacggcacaacggttattcctaaccggggtgcttggttagaacttgaaactgacgccaagaatgtctcatacgtacggatcgatcgtacgcggaagattccattgacggaattagtccgggccttaggctatggttctgacgatgacattattgacatgttgggtgaaactgacagtttgatgttgacgttggaaaaggacgttcataagaacaccgacgactcccgggttgaagaatccttaaaagatatctacgaacggctacgtcctggtgaacctaagacggctgacagttcgcggagcctattgactgctcggttcttcgatccaaaacggtatgacttcgcaccagttggtcgctacaaggttaacaagaagttaagcatgaagacgcgcttaatggaccaaacgttagctgagacattagctgatcctgatactggtgaagttattgcgcaaaaggatacggtcattgacaagaatgtcatggctaaactatccccatacttggaacgtgacgactttaagacggttacttacacaccatctgacgaagccgttgttacgaatccaatggtcttacaagttgttaaggtttattcacaaaacgaccctgaaaaggttgtgaacgtgattggtaatggcaacattgatttgaagttcaagcacattgtgcctgctgatatcattgcttccattaattacttcttcaacttgcaagaaggtcttggctcaaccgatgatattgatcacttgggtaaccggcggattcgttccgtgggtgaattattgcaaaaccaattccggattgggttatcccggatggaacgggttgtgcgtgaacggatgtcgattcaagatgctgcgacggtaacgccacaacaattgattaacattcgcccagtggttgcttcaattaaggaattctttgggtcatcacaattgtcacaattcatggaccaaaccaaccccttaggtgaattaacgcataagcggcgtttatcagccttaggacctggtggtttgactcgtgatcgggccggatatgaagttcgtgacgtgcactatacccactacggtcggatgtgcccaatcgaaacgcctgaaggccctaacattggtttgatcaacagtttgtcttcttatgcgaaggtcaaccgttacggcttcatcgaaacgccataccggcgtgtcgattggacaacgcataaggttaccgataagatcgactacttagcagccgatgaagaagaccaatttgtgattgcacaagccaactctccattgaatgatgatggttctttcgttgaagacactgttttagctcgtaacaaggaagaaaacttggaaacgccaatcgaaaatgtcgattacatggacgtttcgcctaaacaagtggttgccgtcgcaacggcatgtattcctttcttggaaaacgatgactctaaccgtgctttgatgggtgccaacatgcaacgacaagcggtgccgttacttgatcctcacgcgccattaattgggactgggattgaatataaagctgcacatgactcagggattgccttgatttgtcgtcatgaaggaacggttgaatacgttgatgctcgcgaagttcgcgttcgtcgcgatgatggttcattagacacttacaagttaatgaaattccgtcgttctaacggtggtaagaactataaccaacggccaatcgttaaagttggcgatcacgttgataacgatgaagtcttagccgatggtccagcaatggaaggtggggaattagcccttgggcaaaacccattagttgctttcatgacttggaatggttataacttcgaagatgccatcattattaatgaacgtttagtccgtgaagacgtctacacgtcaattcatattgaagaatatgaatcagaagcacgtgacaccaagcttggacctgaagaaatgactcgtgaaattcctaacgtcggggaagatgcattgaagaaccttgacgaagacgggattatccggattggggccgaagttaaagacggtgacatcttggttggtaaggtaacgcctaaaggggttacggaattgtcagctgaagaacggcttctccatgcgatctttggtgaaaaggcgcgtgaagttcgggatacgtcactccgggttcctcatggtggcggcggtatcatccaggacgttaagatcttcactcgtgaaaacggtgatgaattatctcctggcgttaacatgatggttcgggtctacatcgcacaaaagcggaagatccaagttggtgacaagatggccggtcggcatggtaacaaagggacggtttcaatcgtggttcctgaagaagacatgccgtacatgcctgatgggacaccaatcgatatcatgttaagcccaatgggtgtgccttctcgtatgaatatcgggcaagtgctcgaattgcatttggggatggctgctcggaagttaggaattcacatggcaacgcctgtctttgatggtgctcaagatacagatatttgggaagccattcgtgaagctggggttgattcagatgccaagtcgatcgtctatgatggtcggactggtgaaccgttcgataagcgggtcgctgttggggtcatgcactacatgaagcttagtcacatggttgacgataagatccatgctcgttcaatcggaccttactctttggttacgcaacaaccacttggtgggaaagcgcaatttgggggccaacgtttcggtgaaatggaagtttgggccttggaagcttatggtgcagcttataccttgcaggaaatcttgacttacaagtccgatgacgttgttggtcgggttaagacctatgaagcaatcgttaagggcgaaccaattccaaagcctggcgtgccggaatcattccgcgtgttggttaaggaattgcaagcactcggtcttgacatgaaagtcttggattctgaagacaaagaaatcgaattgcgggacatggatgatgatgacgatgaagttgtcaatgtcgatgcactcagcaagtttaaacaacaacaagatgagaaggctgcggacaaggccgcaaaagctgacgccgctaagccttctgaaacaaccaacgctcagcaagataatcaataaaaagggaggtcggtcctttgatcgatgtcaacaagtttgaaagcatgcaaatcggtctggcatccccagacaagattcgcagctggtcatatggcgaagtcaaaaagccagaaaccattaactaccggacattgaaacctgaaaaagacggtctgtttgacgaacggatttttggtcctactaaggattgggaatgtgcttgtggtaaatacaaacggattcgttataagggtattgtctgtgaccgttgtggggtcgaagtgactcgtagtaaagtccgtcgtgaacggatgggtcatatcgaacttgccgcaccagttactcacatctggtactttaagggaattcctagccggatgggcttagtcttagacatgagtccccgggcacttgaagaaatcatttacttcgcttcatacgtcgttatcgaatctggtaatacgccacttgaaaagaagcaattactttctgaacgtgaataccgtgagaagaaggctcaatatggtaacgaatttgaagctgccatgggtgccgaagccatcaaacggttattgaataacgtggatcttgaaaaagaggcacgtgatttaaaggaaactctgaaggatgcttctggtcagaagcggacccgggccgttcggcggcttgatatcatcgaagctttcgtgacatctggtaacgaaccagcttggatggtaatggacgcaattccggttattcccccggacttacggccaatggttcaattggaaggtggtcgttttgccacctctgacttgaacgacttgtaccggcgggttatcaaccgtaataaccggttgaaacgcttgttggacttaaatgcacctgggattatcgtgcaaaacgaaaagcggatgttgcaagaagccgttgatgcgttgatcgataatggtcgtcgtggccgtcccgttgctggtcctggtaaccggccattgaagtctctttcacacatgttgaaagggaagcaagggcggttccgtcaaaacttacttggtaagcgggttgactattctggtcgttcggttatcgatgttgggcctttcttgaagatgaaccaaatgggcttaccacgtcaaatggcgttggaattgttcaaaccgtttatcatgaaggaattggttaaacgtgaattagcttctaacatcaagaatgctaagcgaaagatcgaacatgctgatgacgatgtctggggtgtgttggaagacgttatcaaggaacatcctgttctcttgaaccgcgcccctacgcttcaccgtttagggattcaagctttcgaacccgtcttggttagtggtaaagcgatgcggctccatccattggcttgtgaagcttacaacgccgatttcgatggggaccaaatggctattcacgtcccactttcagatgaagcccaagctgaagcacggctcttaatgttggctgcccaccatattttggcgcctaaggacgggaaacccgttgttacgccatctcaagatatggttatcggtaactactacttgacgactgaagaaatcggtcgtgaaggcgaaggtatgatcttcaaggacttgaatgaagcgcaaaaggcttaccaatcaggttatgtacatttgcatagccgggtcggcattcaggtctcatcaatgcctgacaagccattcacggacgatcagaagcaagcagtcttagtcacgacggttggtaaggcaatcttcaacaacattttgcctggcaagttcccttacttgaacgaaccaactaacgataacttgattgctggtacaccggacaagtatttcttgaagcctggtgaagatattcatcaattcttggatgcccaggaaatcattccaccattcaagaagggcttcttggccgacattatcgctgaagtttacaagcaatatcacgtgacagcaacgtcactcttgcttgaccggatgaaggacttaggttacaacatttcaactaagtctggtttgacggttggggttgccgatattactggtttgaaagaaaaaccagcaattatcgccgaagcccataaacaagttaatacgatttcaaaacagttccgtcgtggtttaattactgatgacgaacgttatgaacgggtcattggtgtctggaacgacgctaaggaccaaatccaacaaaaactgattgaaagtttcaacgcggataacccaatctttatgatgagtgattctggtgcgcgtggtaacatttcaaactttactcagttagctgggatgcgtggtttgatggctgcccctaacggtaagatcatggaattaccaatcctttcaaacttccgtgaaggtttgtctgtcttggaaatgttcatttcaacccacggtgctcgtaaagggatgaccgatacggcgcttaagactgccaactcaggttacttgactcggcgtctggttgatgtggctcaagatgttatcgttcgtgaaaaggattgtgggactgaccgtgggttgcggattcacgcaatcatggaaggtaacgaagtcatcgaaccgttgtatgaccggatcttaggtcgttacacgatgaagactgtctttgatcctgaaacgcatgatgaaattgtcggtaacaacgtcttgatcgacgaagacttagctcataaaatcgttgatgctggtgtaacggaagttacgatccgttctgcatttacttgcaacactaagcatggggtttgtgaacattgctacggccgtaacatggctactggtgatgaagttgaagttggtgaagctgttgggacagttgccgcacagtctatcggtgaacccggtactcagctgaccatgcggaacttccataccggtggtgttgccggggacgatattacccaagggttgcctcgtgtgcaagaaattgtggaatcacggaatcctaaagggcgtgccgaaatctcagaagttactgggacggttgaattaattgaagaaaatccagcggaacggacgaaggaagttacggttaagggtgaaactgatacccggacttacacgttgccgttaacagcacggatggcggttagtgaaggcgactttattcaccgtggtgctgcgttgaacattgggtcgatcgatcctaagcaattgattcaagtacgtgatgtcttatcaactgaaaactacttgctccgtgaagttcaaaaggtttatcggatgcaaggggttgaaattggcgataagcacgttgaaatcatgattcggcaaatgttacggaaggttcgggtcatggatccgggcgataccgacgtcttgcctgggacgttaatggatattgcagacttcaaggacgagaactacaagaccttgattgctggtggtattcctgcaacgtcacggccagtcattcttgggattactaaagccgctcttgaaacgaatagtttcttgtcagctgcttcattccaggaaacgacacgggtcttaactgatgctgctattcgtggtaagaacgatccactgatcgggcttaaggaaaatgttatcattggtaagatcattcctgctgggactggtatgccggtttaccgtcatatcaaaccaaaggaagttggcaacgtggctgatggggtttactcaatcagcgaccttgaaaaacaaatgcaagaacaagatgctagcaagtaattgctaagtaactaaaaagggcggccattgtggtcgtcctttttgtatgcacgattgtaggtaggctatctggggcgttcggcgatgaaggttaatcttcagggggggaagactaactgagcctcgctggaaaagttcaagtttgtgtaaacttgcttagttagtgtgtcctgcactgcgctccaggcatttctgctaattgctggactgccgtgccttaatactatattggtgaaacgtgttcagattggaatgagactttcggttagctaacactaatcctcagtctcagcccgtctaaaccgcacactcttgtagtgctaagaaacgtcttccgctcgggatggtgttcgaatggtgggcacgtgcgtacgcaacttttgacggattagtcgttacttttttgagaccggaatcttatcaggtaactttcaggttaataatagaattgtgagctgtccccgatttctaaatcaccatattactactgagggtcagaacaactgatacgatattaacgcttgtttaaagttccaagtagtaaacaattcgacgacaaattgtaccagttgagtggtcgttcatccgaacaggacgcgcactgactaacaagcaataatcggacgtactagaacattgcaattatagctcgctatgcgagacccgtgagttgggtgaccatgatgaagctccaactgatgaagggcacgaatggtaagcgatggtgtggggcactgatgataaaaccaactaatgcggcaacggccgcaatggcgagacaggtcaacagtgtgtcggctggaatgatgaaaacaagcatgagtagaatgtcaacatcgccgagaccaaaggtggcagttagccgggccagcaagtataacccgactagtaaggcaagtacgaggtagagactgatcgtcaggggtggccgttgttgccataagcccagtccggctggaagaagtaatgtcagcgggtagacttcaaaagtgagataatcagtaagactattgaaaatcaataccaagtaaccaatcagaagtggcagcgtcaatgacaatgacgcactgctagaagctagtagactaccacaaagtaattcaatcagactggaacggaggctgataggagtgcgacaatcatagcactgtccccgttgaagtagaatgccgagtaatggtatcagttgccagaaccgtaattgatgccggcagtgtggacaccttgatcgttgagtgctaatgagtatgtgtccgttgctgatgcgttccgccatacaggtcacgaatgagcccagacagaggccaataataaaaagactgctggttaacatggaaggaccacctttcatcactagttacgcaatgtaaagcaccactattttttcaggacatttattgacaacttcggcatgtcatgatagtctagtaaaggtgctttttgcagacagattcctgtatcaggaatacagacatgctgactggtcggctaagcgcacaattaccatgctccaggcattcttttttactcaaaaaagaaccacctggatgtgtggacttaaaaaacagatatttggaaggaggacactttagaacatgccaacaattaatcaattaattcgcaaaggccgtaagtctaaagtatcaaaatcaaatgccccagcgttaaactttgggtataacagttacaagaaggttgcaactaataacccagcgccacaaaagcgtggggttgctactcgtgtcggtaccatgactcctaagaagcctaactcggctttacggaagtatgcccgtgtacgtttatctaacttaatcgaagttacagcttacattcctggtattggtcataacctccaagaacatagcgttgtcttaattcgtggtggtcgtgttaaggatttacctggtgttcgttaccatgttatccgtggtgctttggatactgctggtgtcgaagatcgtcgccaaagccgttccaagtatggtaccaagaagccaaagaaataataaggaggtaagttaaatgccaagaaaaggtgcacctgcaaaacgcgaagttttagcagatccaatgtataactctaaattagtaacgcgtttaattaaccacttaatgttagatggtaagcgcggtaccgcatcaactattttgtatgatgcttttgatcaaatcaaagaacaaactggtaacgatcctttggaagtcttcgaagaagctatgaagaacgttatgccagtacttgaagttaaggcccgccgtgttggtggttctaactaccaagttccaatcgaagttcgcccagatcgtaagacgactcttggccttcgttggatcgttcaatatgctcgctcacgtggcgaacacactatgtccgaccggttagctcgtgaaatcatggatgctgctaacaatactggtgcttcagttaagaagcgtgaagatactcaccggatggctgaagccaaccgtgccttcgcccattatcgttggtaatatttccgtgagatggttaaaggtcgcctttaactaatcacaaaaaggtgactattatatgcgcgcatatagtagtcattttttgaaataaactttatactgttaattccatttatattgagaggagtaacacattttctaatggctaatacacgagaattctcactcgataagacccgtaatattggtattatggcccatatcgatgctggtaagaccacgactactgaacggatcttgtactacactggtaaaattcacaaaattggtgaaacccatgatggtgcttcacaaatggactggatggcccaagaacaagaacgtgggatcaccattacctctgctgccacgactgcacagtggaagaaccaccggattaacatcatcgataccccagggcacgttgacttcactgttgaagttgaacgttcacttcgggttttagatggtgcgatcgccgtattggatgcccaatcaggtgttgaacctcaaactgaaacagtttggcgtcaagcatcaacgtataacgttccccggatcgttttcgttaacaagatggacaagattggtgcggacttcaagtactctgtaagcacgatccatgatcgtttacaagctaacgcccatgctatccaattaccaattggtgccgaagacaatttcgaaggggtcattgacttaatcgaaatgaaggctgacctttatgatgaagatcaacttggtactgaatgggatacggttgacgttcctgatgaatacaaagaagaagcccaagctgcacgtgatgacttaatcgaagccttagctgacatcgatgacggcatcatggaaaagtaccttggcggtgaagaaatcagcaaagaagaaattaaggctgctatccgtaaaggaacgttagcacttgaattcttcccagtattagctggttcagccttcaagaacaagggtgttcaaatgttaatggatgccgttgtggactacttaccatcaccacttgatgttaagccatacaaggctactgatcctgaaactgaagaagaagttgacttgattgccggtgatgataagccattcgctgccttagcatttaaggttgctactgacccattcgttggtcgtttgactttcatccgggtataccaaggtactttggaatctggttcatatgtcttgaacgccactaaggacaaacgtgaacgggttggtcgtttacttcaaatgcattctaaccaacggaaagaaatcccagaagttttctctggtgatatcgccgctgcaattggtttgaagaacacgactactggtgactcattgacttcgattgaacatccatatcacttggaatcaatggaattccctgacccagttatccaggttgccgttgaacctaagactaaggctgaccaagataagatgaacgttgccttacaaaagctttctgaagaagatcctactttcaaggctgaaactaaccctgaaactggtgaaactttgattgccgggatgggtgaattgcatttggatatcatcgttgaccggatgcggcgtgaatttaacgttgaagccactgttggtgcgcctcaagtttcataccgtgaaacctttactaagagcactcaagttcaaggtaagtttgttcaccaatctggtggtaaaggtcaatatggggatgtttgggttgaatttacacctaacgaagaaggtaaaggcttcgaattcgaagatgccatcgtcggtggggttgttcctcgtgaatacattccttcagttgaacaaggtttgaaggaagctatggctaacggtgtgttagctggttatcctttggttgacgttaaggctaagctctatgatggttcttaccatgatgtcgattctagtgaagcagccttcaagattgccgcatcattagcattgcggaatgccgttaagactgctggccctgttatccttgaacctatcatgaaggttgatatcgttgccccagaagattacttaggtgatgttatgggtcacgttactgctcgtcgtggtaacatcgaaggtatggaagaacgtgggaatgcccaagaagttcacgcatacgttcctttggctgaaatgtttggttatgcaaccacattacgttcagctactcaaggtcgtgggactttcacaatgacctttgatcattacgaaaaggtaccaaagtcagttcaagaagatatcatcaagaagaatggcggcactcctgccaaataagcttgattgataataagaaggacgttcagcttcggctggacgttctttttttacataaatttcttgtcgaactaaatgtgattactgctcgtcgtaagacagcgtggcacatcaattgaagcggcttagggatagttttggccgtcactagcattgggtacggctgtgacgagcacagtgctgctcaggcctatgtcatcgcgcaagggtacaaccgcgcaacaagggtcgcactagttaagttactagccgctgcgaccataaaactggcagccataatattaagggtgcgagactcatagcataataaggagaacgcggacaacatcgcattttttgtatcggagatgaccacttgagttgacggttgtcggtgaccacggccaaggtgctgacggtcggtgataagcagatgacaatataatagaaggtagatgaacaagaacgtgggtcagtgtaacggcgccgtcagatgtaggagcggttgaattaagcgtgttgaagtccgattaaatgactccagacaaaaatgtatgacgctgaacgcgggtcttgttcctgagaaagtgttaatgcaatctagtaggtgtccacatgatcgtggccggtcggcagtgagaaatgtaaagcgctcaccaaaaagaaattaggcgcaaacgctattaattggatggaatttgtgttacattaattgagctggttcaaaaaggtaacacggtttacaacgatggttataaaaaaagtgcgaaaacacttgctattacagagcttttcatttattatagattgtgcttggtatttagaaggggataactatatccccatcatcaagtagtcgtagttagctttgatgtgaaaggttgcgacacgcccggccacattgtcatgggacgtggcggtaattttcacggagctagtcttattttcaaaatagacgaaggaggtcacaacaatggcaaagcaaaaaattcgtattcgcttaaaggcatacgaacaccgcattcttgatcagtcagctgacaagattgtcgaaacggcaaagagaactggtgctactatttcaggtcctattccattgcctactgaacggactatttataccgttctacgttcaccacataagtttaaggactcacgtgaacaattcgaaatgcggactcacaagcggttaatcgatatcgttaacccaacgcctaagacggtcgactcattaatgaagttagacttgcctagcggtgtagatattgaaatcaagctttaatttactaaactaaaatcaattaattggaggtgtactcatgaccactaaaggaatcttagggaaaaaggtaggaatgacgcaagtcttcactgaaagcggcgaattagttcccgttacagttgttgaagttcaacctaacgttgtgttgcaagttaagaccgttgaaaatgacggttacgaagcaatccaattaggtgctgacgacaaacgcgaagtcttgacgaacaaacctgctcaaggtcatgcagcaaaagcaaaaacgactcctaagcgcttcattcgtgaaattcgtaatgttgagcttggagattacacagtaggtgacgaagtcaaagcggatattttcgcagctggcgacgccgttgacgttacgggtatcactaaaggtcatggttaccaaggtaatatccataaggacggccaaagtcgtggaccaatggctcacggttctcgttaccatcgtcgtcctggttcaatgggtgccatcatcaaccgggtattcaaaggtaagaaattaccaggccggatgggtaatcaccaacgtacgatgcaaaacttacaaatcgttcgtgccgacgttgaaaacaacgttttattaattaaagggaatgtccctggcgccaacaagtcatttgtaacagttaaaacatctgttaagagtaaataaggaaggaggacataatacatgactagcgtagcattatttaaacaagacggtacgcaaaatggtgacgttactttgaacgacgctgtgtttggtgttgaaccaaacgaaaacgtggtttttgatgccatcttgatgcaacgtgcatcaatgcgtcaaggaactcacgcagttaagaaccgtagtgctcgtcgcggtggtggtcgtaaaccatggcgtcaaaagggtactggtcgtgcgcgtcaaggttctatccgttcaccacaatggcgtaaaggtgggattgtcttcggaccaacccctcgttcatacagttacaaattacctaagaaggttatgcgcttagctttgaagtctgtcctttcacaaaaggtcttagacaacagcttagttgcagttgatagcttagctttcgacgcaccaaagactaaggattttgtaaatgtattaaacaacctcaacgtcgataccaagactcttgttttggttgaagaggacaatgaaaaggctgctttggcaggtcgtaacttaccaaatgttaagatccttaaagccaaaggtgttaacgtcttagatgtcgctaatagtgacaaattagtcgttacccaaaaagccctcgatcaattagaggaggcgctcgcataatggaagcacgcgatgtaattttacgtcctgtagttactgaatcatcaatggctgacttggacgacaagcgctacacatttgatgtcaacgtacaggcaacgaaaacccaagttaaaaaagcaatcgaagaaatcttcgatgttaaagtcgttaaagtgaacgttatgaacgttaaaggaaaacttaagcgccaaggtcgttacgccggctacactaagaagcgtcgtaaggctattgttaccttaagttctgattctaacgaaatcaagttgttcaacgacgatcaacaataaatctaatttaggaggtaactctagtgggtattaagaagtataaaccaaccactaacggccgtcgtaatatgactgcttcagatttctctgaaatcactaagacgaagcctgaaaagtcattattagactcacaaagtcacactgccggtcgtaacagttatggtcacattactgttcgtcatcgtggcggcggtcataagcaacaataccgtttggttgactttaagcggattaaggatgaagttccagcaaccgttaaggcaatcgaatatgatcctaaccggacagctaacattgcattattagtttacgctgacggtgtgaaatcatatatcttagcaccaaaaggtttggaagttggtatgcaagttcaatcaggtgccgaagccgacatcaaggttggtaatgcattaccattaactaacatccctgttggtactgttattcacaacattgaattgaagccaggtaagggtggccaattagctcgctctgctggtacttcagcacaattactgggtaaggaaggcaagtacgcaattgttcgtttgtcttctggtgaagttcgtttagtattattaactagccgcgctactattggtactgttggtaatgaacaacacgaattaatcaactcaggtaaagccggtcgtacacgttggcaaggtaagcgcccaactgttcgtggttctgtaatgaaccctaacgatcaccctcatggtggtggtgaaggtaaagcaccaatcggtcatccatctccaatgtctccatggggtaagaagacgcttggtaagaagactcggaacaagaaggctcgttcaaacaagcttatcgttcgtggtcgccgtccaggcaaacactaataaaatttgaatttactgtagttatcgagaggaggtcacacgatgggtcgtagtttaaagaagggacctttcgcagatgcgcatttattaaagaaaatcgatgcacaatctgattctgacaagaaatctgtcatcaagacgtggtcacgtcgttcaacaattttcccaagttttatcgggtacacaatcgctgtttatgatggtcgcaagcatgtcccagtttacatccaagacgacatggtcggtcataagttaggtgaatttgtaccaacacggacgttccatggtcatggaactgacgataagaaaacgaagtaatagttaggaggatataaagaatggctgaacaagtaacatctgcacgtgcaactgcaaaaactgttcgtattgccgctcgtaaggtccgcctagttgtcgatcttatcagaggtaaaagtgttgccgaagccttagcaatcttgaagttcactccacggggtgcttctccagtagtagaaaaagttttactttctgctgttgctaacgctgaaaataactttgacttagatcgcgaagatttggtcgtaagcgaagcttttgttaacgaaggaccaaccttaaaacggttccgtccacgggcaaaaggttctgcttcaccaatcaacaagcggactagccacattacgatcacagttactgaaaaataggagggataacgcgtgggtcaaaaagtaaatccaaccggattacgtgtaggaatcattcgcgactgggaagcaaaatggtacgctgaaaaagattttgctgcctacttgaacgaagatttacgcatccgtaagtatatcgaacaacgacttgccgacgcttccgtctccaccgttgaaatcgaacgcgctgcaaaccgcgtaaacatttcaatccataccgcaaaaccagggatggttattggtaagggtggttctgaagttgaagctcttcgtaaagaattaaacaatttaactggtaagcgagtacacatcaacatcatcgaaatcaagaagcctgatttagatgctaaattagttggtgaaagtattgcgcgtcaattggaaggccgggttgctttccgtcgtgcgatgcgtggtgctatgcaacgtacaatgcgttccggtgctaagggtattaagacacaagttgctggccgtttaaacggtgccgacatgtctcgtgttgaagcatactcagatggtacggttccattgcatacgcttcgtgctgacatcgactattcatgggtcgaagcacggacgacttacggtaaattaggtgttaagacctggatctaccgtggcgaaatcttgccagaaaagaaatctgctaaaggaggaaactaaacatgctggtacctaaacgggttaagtatcgtcgtgttcatcgtggtaaaatgcgcggtgaagctaaaggcggtaaaacagttgcttttggtgattacggtttacaaaccctcgaatcacactggatcagcaaccggcagattgaagctgcccgtgttgctatgaaccgttacatgaagcgtggcggtaaggtatggattaagattttccctcacaagtcttacactgaaaaaggtgtcggtgtccggatgggtaatgggaaaggtactcctgcaggttgggtagcaccagttaaacgtaacaagattatgtttgaagttgctggtgttccagaagaagttgcacgcgaagctttacgcttggctggaactaaattacctgttaaaactaagattgttaagcgtgaggaagtaggtggcgaatcagatgaaggctaaggaaattaaagcattgtccactactgaaatgctcgaaaaagaaaagtcttacaaagacgaacttttcaacttgcgttttcaattggccactggtcagcttgaaaacaccgctcgtttaaaacaagttcgtaagaacattgcgcgtattaaaactgcgttgcgtgaacaagagttaaacaagtagagtataaaggaggcaatcacgaatgagtgaagatactcgtaatagccgtaaggttatccaaggacgcgttgtttctgacaagatggacaaaaccattgttgttattgtcgaaacttacaagaaccatccggtatacggcaaacgtgttcgttattcaaagaaattcaaggctcatgatgaaaagaatgaagccaaaactggcgatatcgtcaagatcatggaaactcgtcctctatcagctactaagcgtttccgcttaattgaagttgttcaaaaagctgttattatctagattattagctgaataaaattacatgaagggaggacacttactgtgatccaacaagaaagtcgtttaaaagttgctgacaactccggtgcccgtgaaatccttactattaaggtattaggtggctctggtcgtaaaactgctaacattggtgatgtcattgttgctacggttaaacaagcaacacccggtggtgttgtcaaagctcatgatgtcgttaaagctgtgatcgtccggactaagtctggtgttcaccgtgctgacggttcatacatcaagtttgatgaaaatgctgcagttattattcgtgatgacaagactccacaaggtactcgtatctttggacctgtcgctcgtgaattacgtgataaggacttcatgcgtattgtttcattagcgccagaagtactctagtcacacaccgtaaataaggaggtgcgcaacctaatgttgattaaaactggtgataaagttcgagtaatcagcggtaaggatcgtggtcaagaaggtactgttaaaaaggttatctctgccaagaaccggatcgttgttgaaggtgttaacaagatcaagaaacaccaaaaaccaacgaacgttaacccacaaggcggtatcgtggacatcgaagcaccaatcgatgcttctaacgttatgtaccttgacccatcaaccaacgaacctacacgtttaggtgttcgtcgtgaagatggcaagcgtgtccgttacgctaaaaagtctggtaaagacttagaaaactaagactgactgaaaggaggaagcaagtttcatggaaaaccgtttaaaagctcaatatgaaaaagaaatcgttccagcattagttgacaagttcaattacacttcagtaatgcaagtgcctaagctggctaagatcgttttgaacatgggtgttggtgatgcagttaccaacgctaaaaacttagacgaagcagttgaagaattaactttgatctccggtcaaaaaccattggttacccgggcaaagaaatctatcgctggtttccgtcttcgtgaaggtatggcaattggtgccaaggttgacttacgtggcgaacgtatgtatgacttcttggacaagttgatcaatgtttcattaccacgtgttcgtgacttccatggtgtaagtactcgttcatttgatggtcgcggtaactacacattgggtgtccgtgaacaattgatcttcccagaaatcaactatgataatgttaaccgtgttcgcggtttagacattgtaatcgttacgacagctgatagtgatgaagaatcacgtgagttgttaactcaatttggcatgccatttgctaaataaccgaagggggttaatcgaagttggctaaaaaatcacaaattgctaaacaaaagcgcggtgctaagtttaacgtacaaaactacacccgttgtgaacgttgtggtcgtccacattcagtttaccgtaaattccacttgtgccgtatctgcttacgcgacctggcccacaaaggtcaaatccctggtatgaaaaaggccagctggtaaaaacaaacccaagttaaaggaggttaaactttcatgatgactgatccaatcgcagatttcttgactcgtatccgtaacgctaacatggtacgccacgattcactagaagttcctgcatcaaaaatcaaacgcaacattgctgaaattttaaagaatgaaggttttgttcgcgacgttgaatacatcgatgatgacaaacagggcatcatccgcgtcttcttgaagtatggtaaggacaacgaacgtgtaatcagtggcttgaagcgtatttcaaagccaggtttacgttcatacgtcaaggctgatgctgttcctaaggttttaaacggtttagggattgctatcatctcaacttcagaaggtgtcattactgataaagaagctcgcgccaagaagcttggcggcgaagtattagcttacgtttggtaatcattaattaagacgggaggtgcaagtaagtgagtcgtattggttataaagtaattgaactacctgctggggtagaagtatcacaagctggtgaagtcgttacggttaagggtcctaagggtactttaacgcggaacatcgccagtgatattacgatgacggttgaaggcaacgaagttaaattcactcgtccatctgatgactacaagatgaaggcattacacggtactacccgtgcaaatgttaacaacatggttgaaggggttactaagggctttactaagaaccttcaattggtcggtgttggttaccgtgcccaattgcaaggcaagaagttagtattaagcgttggttactcacaccctgttgaattcgcaacgcctgaaaacttgactgttgaagttcctgataacacgcatatcaatatttctggtattggtaagcaagctgttggtgactttgctgccgaagttcgggccgttcgttcacctgaaccttacaaaggtaaagggattcgttacgtcgatgaatatgttcgtcgtaaggaaggtaagactggtaaataatgcagcgtaaagctgtccatactaatatatagaggtgactattgtgatttccaaaccagataaaaacaaaacacgtcaacgtcgtcacgcacgtgttcgcggtaagatttctgggactgctgagcgcccacgcttaaatgtttatcgttcaaacaaaaacatctacgctcaagttattgatgatgtagagggtgtaacgctcgcaagtgcctcaactttagatagcgaagttaaaggtaacaacaagactgaaaaggctgcatctgtcggtgaagttgttgctaagcgcgctgctgaaaagaaaatcgttgacgtcgttttcgatcgtggcggttacttatatcatggtcgggttcaagctttggctgaagccgctcgtgaaaacggacttaaattctaacaaaggaggaataataccatatgactttcattgatccatcaaaattagatcttgacgataatgttgttgccattaaccggattaccaaagttgttaaaggtggtcgtcgcctacgttttgctgcattagtaatcgttggggaccacaagggacacgttggtttcggtactggtaaggctcaagaagttccagaagcaattcggaaagcttccgaagctgctaaaaagaacttgatcactgtaccaatggttggtaccaccattcctcatgaagcacttggtgtttacggtggtggccgcatcatgcttaagccagccgttgaaggttctggtgttgccgctggtggcgccgttcgtgccgtcatggaattagccggtgtggatgatgttactagtaaacgattaggctcaaacacccccgttaacgttgttcgtgcaacgttcgaaggcttaaagagcttaaagactgctgaacaagtcgctgctttacgtggcgtttcagccgaacatttagctgaatagggaggacaaacaacatggctcaattaaagatcactttagtacgcagtgctgctcaccgtcttcctaagcaacgtaaaatcgttaaggaattaggtttgggtcggattaatagttccgttgttaaacctgatgacgcagcaactcgcggtcaaattttccacatcgcacacttagtcgatgtcgaaatcatcaagtaattcaaattttcaaagaggaggtgcctactaaatgaagttacatgaattaacacctagtgaaggttcacgtttttcacgtcgtcgaattggtcgtggtgactcaagtggccaaggtaagacttctggtcgtggccaaaaaggtcaaaaggcgcgtggtaaagttcgtgtcggtttcgaaggtggccaaatgccattgtaccgtcggattcctaaacgtggatttactaacattaaccgtaaagaatatgcggttgttaaccttgacggcttaaaccgttttgatgatggtgccgaagttacaccagaatcattaaaggaagctggcttagttaagaagagttctgctgttaaagttcttggtaatggtaaactcaacaaaaagttaacagttaaggcaagcaagttctctgcaacggcggttgcagccattgaagctgctggcggtaaaactgaggtgatctaatttgctgactaccatgaagaacgctctcaaagttaaggatattcggaataaacttctgttcacgttgggcgttttgattgtatttcgtcttggctcttatatcacagttcctggagttaatgcacaggcacttcagtcggtggcatcttcagggctgataagtatgttgaatacattcagtggtggcggtttaacaaattattccatccttgctatgggggtatccccttacattactgcacaaatcatcgttcaattgttacaaatggacattgttcctaagtttgttgaatggggcaaacaaggtgaagttggtcgacgcaagcttaatcaagcgacccgttggttaacgatcgtcttggcctttgttcagtcgattgggattacggctggttttaactctttgagtcaactcaagctcgttaacaatccaagtatttcgacttacctgaccattggggtgatcctcactggtggggcaatgttgacgacttggatgggtgatatgattacggatcgaggaatcggtaatggggtttccattattatcttcgccgggatcattgcccgtatgccaacatcgatttatcaaatttatcaagaacagttcgttaatgtttcacagagcgactggtggaagagtggcttgtttgttgttgggttagccttgcttgtgctgatcatcgttatgtttgtaacgtgggtcgaacaagctaatgaccgaattccaattcaatacactcgtcgtgcagctggtgcacctgacagtagttacctaccattaaaggtgaacgttgccggagttattcctgttattttcgcgagttccttcattgcaacgccccaaacgattttgctaggattccaatccagtcatggtgacgaaacctggtataccgttttgagtaatatcttcaatatgcagtcgacgactggtgctattctttacaccattctgatcgtgctcttcacgttcttctatgcgtttgttcaggtcaatcctgaaaagctctctaagaacttacaaaagcaaggcagctatattcctggtgtttggccaggtaaggatactcaagattgggtttcaaaattgttaatgcgactaagtacggtcggtgccctctaccttgggttgatttccttgattccattattagcttctgatatttggggtctcgatgaatcaatcggtttaggtgggacgagtttactaatcgttgttggggttgcccttgaaacaattcgtcaaattaaaggattgatgatgaaacgtgactatgtcggtttcattcgttaatcagcgaatgtgttggggagactcaacacatttgtgcattcaggaggaaaaaacatgtcaacaatgaacctgattttaatgggcttaccgggtgccggtaagggtactcaagcacagaagattcttgaagattttgatattccacatatctcgactggagacatcttccgtgcagccattaagaacgaaacgaagatgggcttggaagccaagaagtatattgatgcaggtaacttagtaccagacgaagtcactaacggcatcgtccgtgatcggttagctgaagcggatactaaaaatggtttcctattagatggttacccacgtaacatcgatcaagctcatgctttgaaacaaatcggtgaagaactcaataagccacttgatggggtcatcaacattcatgttgaacccgcagtacttgttgaacgactttccggtcggtttatctgccggacttgcggtgcaacttaccataagttgtacaacaagcctaaggtagaaggaacctgtgatgtgtgtggcggtcatgatttctatcaacgtgatgatgacaagccagcaaccgttaagaatcggttagacgtgaacattaagttgaacacgccattaattgattattacggtcaagaaaagttactctacaatgtcgacggtgatcgcgacattgatgatgtctacaaagatatcaagaaaattcttgataacctgtaaaccagattccttcagcagcgacgtttgcttttcaaaggtcgttgtgataaaattattcaggtttagccgttgactgatttaatatttttttaatgttatgattagacaatgactggttcagtaatggaccaaatacgtggtagcacggaatctgataataaggagggacagtacttggcaaaggaagacgtcatcgaaattcaaggaaccattaaagaaacgttgccgaacgcaatgtttaaggttgaacttgaaaacggcgctgaaatcttggcacacgtatcaggtaagatccggatgcattacattcgaattctgcctggtgacaaggttacagttgaaatgtcaccttatgatttaactaagggccggattacctaccgtttcaagtaggctcggtctacgtaccttataggaggtaaaaaactcatgaaagtaagaccatctgtaaagccaatgtgcgaacactgcaaagttattcgtcgtaaaggccgcgtgatgattatctgctctgctaatccaaagcataagcaacgccaaggtaaataatttaattaagttggaggtgaaatattaatggctcgtattgaagggattgacttaccacgtgacaagcgtattgtcattggtttgacttatatctacggtatcggtaacacttctgcacagaagatccttgctgaagccggtgtttcagaagacgttcgtgtacgtgatttaactcctgaccaggaagacaaaatccgtgccgttgtcgatggctacaaaactgaaggtgacttacgtcgtgaagtcagcttaaacatcaagttattgcaagaaatcggttcataccgtggcatgcgtcatcgtcgtggtttaccagttcgtggtcaacacacgaagaacaatgctcgtactcgtaagggtaaaaaggtcagcatcgctggacgtaaaaaataataataaaggaggttttcgaattttatggcaactagaaagacaacccgtcgtcgtcgggtaaagaagaacattgaatctggtgtggctcacatccattcaacgttcaacaacacacttgttatgatcactgatatgcaagggaacgccattgcatggtcatcagctggttcattaggtttcaaaggtagtcgtaagtcaacaccttttgctgctcaaatggctgcagaagctgctgctaaggcatcaatggaacatggtatgaagactgttgaagtcgctgttaagggtcctggttcaggccgtgaagccgctatccgtgctttacaagctactggtttggaagttagcgcaattcgcgatgttacgccagtgcctcacaatggttctcgtcctccaaagcgtcgtcgtgtttaatctgtgacgttcattttgagggcaaacttcattttgtacgcacaactactaaacaccacgcgttttgaaaggggtaaaagataagaatgattgaatttgaaaaacctaacattcataaaattgatgaaaacgacaactatggtaagtttgttgtagaaccgcttgaacgcggttatggtacaactttagggaattcacttcgtcggattcttctttcttctttacctggcgctgctgttactagtattcaaattgatggtgttcttcatgaattttcaacgattgagggcgtaacggaagacgttacagcaattatcttgaatgttaagaagattgcacttaagttggaatcagacgaaaccaagacgttggaaatcgacgttaagggtcctgctaacgttactgccggtgatatcattggcgatgcggacgtagaagtcttgaatccagacttaccaatttgtaccgtagcagacggggcacacttccatatgcgtatgaccgcaaatactggtcgtggttatgtttccgctgaggataacaaacatcgtgaagatgacatgccaattggcgttttagctgttgattcattgtattctccaatcgaacgtgtcaactatcaagttgaaaacacgcgggttggtcaacgtgatgatttcgataagttaaccttagacgtttggacaaatggttcaatcactccaagtgaagccattagtctatcagccaaaatcctgactgatcacctttcaatcttcgtaaatctcaccgatgaagctaaaaacactgacgtgatggtcgagaaggaagaaacgcataaggaaaagatgttagaaatgacgattgaagagttagatctctccgtccgttcatacaattgcttgaagcgtgctggcatcaacacggtccaagaattaactaacaaaactgaagctgatatgatgaaggttcgcaaccttggacgcaagtcactcgaggaagttaaggcaaaattagctgaccttgggttatcattacgcaaagaagactaatacaagggaggatatccgttcatgagttaccgtaaattacaacgtacaagttcacaacgtcgtgccttattacgcgatttgacaacgtcattgatcgttaacggcaagatcgaaacgaccgaagcccgtgctaaggaagttcgttcaactgctgacaaaatgatctctttggccaagaagggtgatttaagcgcccgtcggaaggctgccgcattcatgcgggacgtcgttgccgatgttaaggaagatggcgacaacgtggctgtacaaactgcattgcaaaagctatttagtgacttaggtcctcaatatgctgaccgcaatggtggttacacacgaatttacaagactatgcctcgtcgtggcgacggtgcacaaatggttgtcttggaactcgttgactagttaagattgttttacggatcactgggactgatgattgacgggcgttatgatggtggctactggcaaaatagtagctaagtctagttcggaagttatttatggttagacatagatggcatatcgcagttctaagtgattttttttggtgctagttacgagcgaccgctgatttagggattgattccctaaatcagcggttttttgttggaatggataagtgtttttaatactcgtgatgacaacggtttgttatttgcagattatgacctgttgaatctggaaagtggacatagtggtctcaggtactgactgtgaagatgaagcacatgggcgtttagctgtgtctgggcgacaaaaaaggtatcaaacaggatgtttgataccttagtcgattgattactagttaattatgccggtccaacagccgtttggttagactaatcagatccgtcttcgcaggctggtctggaagtttacgcatgattgccagcgcgtcttgagtgtacttggtagcgagttcttgggcttgcaccacaccgccggcattgatgacaagtcgttgtacttcctggcgctgagtgtccgaaattgccccctgtagtcgcatcagcggcaataaatcgtgcttagcttctgtctgtaaggcaaaaatcaacggcgaggtgtagacaccttcagcaacgtcttcgaggatgggtttgcccgtttcctgactgacttcttgatagtctaaaatatcgtcaagaatttggaaggccatcccaattgcgagacctgctttacgagcgcgctgggcgaaatgactactttgaccagattcataagcacctagaaaacaactcagtgcgaataattcggcggtcttaccttgaatttgttgcaagtattctgccatggtaatgtcaaggtggtagtggcggtccttttgttggacctcgcccactagaatcttttccatgttctcagagttcatctggatgcttttgaaactgcttgaatagtgcgctagaatcttgaacactacaacgaataggtagtcgcccgcatacacagcagtatctttaccaaaacgttcttgaatcgtgacatggtgccgacgtagtgcagcatcgtcaacaatgtcatcatggatcagcgtagcggtatggagcgtttctaatgacgccgctaaggccaccatccgttgccgatcagttgttgtaaattgtgagaataggaggcagtatgccgggcgtaagagcttaccaccaccatgaatcatttctaaaatcgcgtcattgatgtcggcatcttgaatattgatgttcgccgtcatcagctgcatcacttgttgcagctccggttgtagtgccgggtaatcacgccaaattgggtgtaattgtgttgccgattgcataagggttactcctttgtttgatctggatggtgttctcgattgaatttgagatagcgtaagatcgtgacgtgggtgaacaagtagttggcggcgattccgagagcacttcccgctgctagtccaataatcgaaagcactggcaagtagagcataaccgtccacgtctgtgcaataagactcgcgaccaatagctgaccaacattatgcatgacgccaccagttgctgaaattccaataatactaacgcgtttaggccctaattgtttgaccaacagcatggcaaacaggctgagaaaggcgcccccaaaactatacagaaaggttgataaagtgccacctaggagggccgttaaaatcaaacggagccaggttagggttatcacgtcagttaatgataatgtatagattgcaacaatggtaatcagattggctaaaccaagcttggcacctggggcaaaggcaaacgggaatggaatcatccgttcaaggatgccgatgatcacgccttgtgcaaccagtaacgcgatataaatattacgatgagttttgtttgatcgttcaaatgaattattcatattctactccgtaactaaaccattaccgccagatttgacttgaccgttgctggccttaatttcaaccaagagtttgtggggcaaacaaacaatcgtttgaccaggtttatgaatccagcctcggcggacacatacttggtcagaacagttggctttcgtaatcgcaacgcgcttaggtttaaatgtgatcgtgttgtagtgcccatggttatcgcgataggtgaagtgcttagtcgttttcagattcgtaatattgacacgcttcaagacggtcccattatgtgagaccacggcgttatacgtggtttcattgctcgtggcctttcgcttagccactagtgccgcatgttcagcttgttgtttttgctggtatgaaaaaatcgctagtggggtgaacgataaaataattagcgcaacaataataataatatcaaacggcttgatcatatccccataacgtttgaatgtccggatcattgtccgtaatttatgcatcgttaaccctccaattcaatgaaataaaaaatggttcaagggagaaaaacaacccttgaaccatcgggaaaggatttaattaattataacgcatctagcgggttttaacaccgtcgtaatgagaacgaacgttgccgtaccaccagtgtccaaggtgtttttgcatccacggaacgacccagtagtctaacccaaatgtccgtccggaaccgttcattaaggcaagggcaacaaagatcatccaaatattgacccagtagaacatgccagataagcagaagacgacaactaagccaatggtgactgcgttagcaaaccaagtaaagagtccgaagaaaatacataatgcaatgacgatttcaacacaagtcatgaatttctggaagaagagggccatttgcatgttcggaatgaagaccttggtaattgattcgaaccaatgtggcattttgtcaaagaccatcaggggttctttaccgtacatgtatgaaagactgaagacacccttagcggctttagcggttgacgtggcagcttcagaagcaccactggttgcagcggctttagttgcttgagaggcaccactggttgcggccacggtaatccattcgaatggtaaccgtaacttgtcagtgaaccaggattcagatccctgaattttagtccagcagtcccataaccacatggcaccatagaagaaccgcagtggcacactccagagtacgttaccagcccgtgagacccaaccgcggaagacgttacggttattacgagtccggaagaattcgtgcatgaagtactggaataggtagtaacctgagaaaatctgaacgtagtacatccagttgatggcgtgttttaaaagcacggcaataaaaccagagacgttccacttctctaaaacttgtgcaacggcatatttggaaccaattgagtcgacggatgcttgataagcgcccttaaatggcttgatcgtaacgtcagtctggtcaacgttcttaataataccttcgacggccttagctgcggtttcttcagccccttgaacgatttgtgggactggccgtggttggtcaggttcttggtagctggttgaatcaccggctaagaagatattgttacaatccttagcttgcatgaattcattggccatcaagcgaccaccgcgggggttagtttcaatgccgaactttttaacgatactattagcacgaacaccggctgtccagattaacgtgtaggttggaattggatccttgccttttaagttaacatggtcttcacagacttcggtaatcatggagttcgtcatgattttgacaccatgtttttccatgtacttagcggccttaccggcttgcgtccggttgagcatgttaataatagtcggcgctgcttcgaccaattggagcgtgatttcacttggatcgagcttgttgtctcgagccaaaacatcacgatattcgattaattcaccaatcagttcagaaccagtaaaaccagaaccacagactgtaaaggtcaacatggctttgcgcttagcagggtcgagctccgccgccccccgccgaataattgcagataagtgagcgcgcaatgccatcgcttgttcgaaggaccacaattcgaagccgtgttccttaacaccgggagtcccaaagtcattggattccccacccaaactaattaaaagttgatcatattgataacttccgtgttcggtagtaactgtttgtgcctttttgtcgatgcccgtcacggtatcggtcacgagacgaacgttttttcgccgtgcgaacaaccgttgcaaatcatattggatatgctcaggttccacccgttcggtagcaacttcatgtaattcagtcatatacgtgaagtatgaatgccggtcaatcaacgtaatctcgacgtctgcattttttttgaaatgcttagacagtttcttggttgcgtaaacaccagcaaaccccgcaccgacaacgacaatatttttctttgccattgcgtaacaactcccttgaataatagtgtaaaaagataattccactaataattataacgataatgtaagcggttgtctatggattatgggaaagaatgcataaactatcacattatctaagccgcgaaaatagtggcatcgaggtttgaacggaaaacgttgtcaataccgctattattaggctaaaatatcatttttttaatggaatgggattgactattaccagtttaaacgttaagattaatgtgaattttcatacaaaaaggttaggagtgggatatcatgaaattcaaatcagttattacgggtgcttcagttgttgcaatttcagctttagctttagcaggttgtggtagcagttcttcaagttctagctcgagttcatccaagaagagttcatcttcaagctcatcagctaagacaactaaggttgctaaattaaccgctggcagcaaaatgaaagcgggtacttataaccttgaagaagaaaattattcacatggttatcggaccaagatgagtatcacagttaataacaacggtaaaatcactaagtccagttatgaccaagtgaacaagaacggcaagtccaaagttgatgatacttcatataacaaacaaatgaagaagatcgctgggactaaccccaagacttacatgcctaagttaaacaagacgctgacgggctctgccgctactggtaacgtgggctccattgatgttgtgactggtgcgactgaatcatcaaagaccttccaaaactacacacaacaattagttcaagctgcccaagcgggtaacaagtcgaccattaagattgacaatggtgccaagatgaaagatggtacctacaagttgaacgaaaagaactactcacacggttacaaagttactttcgcaatcacggtcaaggataataagattacgaagtctgaatataaccaagtgaacaagaatggcaagtccaaagttgacgatgcagcttacaacaagcaaatgaagaaggttgctaagactaaccctaagacttatcaaccagctttgaacaagtcattagttaagagtagtgatccaactaaggttgacgttgtcacgggtgccactgaatcttctaacacctttattatgtacgcggaacaattacaaaacgcggcacaaaagggtgacaccaacacgattactgttgacaacatgattttctctgaataagcaatttaattattagattcttttgaggcctgaggcgcatgctgagggccttttgtttttaattgaacaaccacaaaagtttgtcactcagttgggcacgactttgagcaagctaaatccatacatggatattggtttaaaaaataatagtggcggtgaatgttaagtgcaaaatggctgtggtagtacaaacccgaccgtcgagttgtaccgtttgctgtaggtgcgctgatgtcagactagcgtagaaaagcttggatgacgcgcaaacagtctcaccggatgaatcaagactttggtataatgacaattgaaattaaaaataggggaagtattggaatgaagctaaaaaaatgggttcgaattggattaattgttgcaatgatcgtgccattgacggcgtgtgggacgagtacgagtcgcaaaaatgctgctagtagccgacccaaaccaactaaggtcgtcaagacgccgatcgaggatacccagttcatgatgggcacagttgtcacgttgcggatttataataagggtaaggataacgtgttagctggggcgtttaagctgttgaaaacggaagctaaggaaattactgtcaatcaaaaaggatctgaaattgataagatcaacgccgctgccggtaaaaagccagtggctgtcagcaaggatatctacccaatgatcaaagcagcttactattatagtaagaattcagacgaatcctttgatttagccattggtccgatcacatcactctggcatattggattttccgatgccaaggtgcccactcaacaagaaattgataagaacgttaagctggtagactacaaaaaagttaaattaaatgacaagaaacggaccgtttatctagaagaaaagggaatgcaactagaccttggtgggattgccaagggttacatgaccgatcaagtgaagacgtacttattaaatcatggggtttcaacggccattattgacctcggtggtaatatttatgttctgggtgacagccctaaagaaacgaagtcaggtaactggacagtcggtatccaagatccaaaagcgtcacggggtacggccattggctcactacctgctaagaataagtcaatcgttacttctgggatctatgaacgctatttgaagaagaatggtaaagtttacagtcatttgatggacccacaaacaggggcaccttatcaaaacaatttgatgggcgtttccatcatctcgaagaagtcggtggatggcgatgcactatcgacggccacctttgacaaaggcctcaaaggcgggatgaagtacattaatggtaaagcggatcaaggtattggggccatttttattaccaaggataaaaaagtatacgtctccaataacttgaagaagcagttcacgctgtttggcgatgctggttacaaatacgggccagccactgatttaaagtaagattggacgtgaagttcagttactacaagttccgtcagatatgttatgataataaccatgaattttaaggaaatgagggacaatggtgagtccgattattgacgttaaacatttagattatcgttacccgcaacaagctacggatcagttaacgttacacgatatttcatttacggtcatgccgggtgaatgggtcgccattgtcggccataacggttctggtaagtcgaccttggccaagaatttaaacggactgttagcaccagcggccggaacgattacggttgatggtcaagtattatctgaagaaaccgtttgggacattcggcgcaaaattgggatggttttccaaaacccagataaccaattcgttggggcaaccgttgccgatgatgttgcgtttagccttgaaaaccagggcgtgccgcgtcctgagatgctaacgcgggtacaggcggctctagaacaagtcaacatgcaggattttgcgacacgtgaaccggcacgtttgtcaggtggtcaaaaacaacgggtggcgctggctggtatgatagcggcgcggcctcagattttgattctggacgaagcgacgtcaatgttggatccccgtggtcgtcaggaagtattgacgacgattcgcgatatgaaggctaattcagcgttaacggtcttgtcaattacgcatgatattgacgaagcggccagcgctaatcgggtcttagtgatcaatgacggtgaggttaaggaagaggggactccagcggaaatttttcagcatggagaagccttaattaagatgggattggacatgccatatgctgagcgcttaaaagcagcgctaaagcggcagggtgttcaagtgcccgcacagtatttaacagagaaaggaatggcggactggttatggcaattacgttcaaacaagtagattttacttaccaaccgggtacgccgttcgaaactaaggcgttaactgatattaacgtcaccattcccaccggctcttatacggctttgattggtcatacggggagtggtaagtctacacttttacagcatttgaacgccttactcaaaccgactagtggaacggtcacgattggtgaacgggtcattacgccaacgacgagtaataaggatttgaaacgattgcggcaacacgtgggcatcgtctttcagtttccagaaagtcagttgtttgaagaaacggtggccaaagacattgcattcgggccccagaattttggggccagcgaagcggatgctttgaaaactgcggctgaaatgttggctttagttgggttagacgagtcgttactgacgcggtcaccgtttgacctctctggtggacagatgcggcgagtggccattgcgggggtccttgcgatgcagccgcaagtcctagtcttggatgaaccgactgccggattggaccctcagggccgtttagatatgatggagatgtttgcccgtttgcgccatgaacgtgatttgaccgtggtactagtgacccatcagatggatgatgttgccaattacgcggataatgtaatcgtgatggatcgtggacaaatcgtcaaaacggggacgcctcgtgagatcttcaaagatcctgcgtggctgactgcccatcaattgggcttaccgaaaacaacggcctttgcacatacactccaaaagcaaggctggcaatttgatgagtggccgttgaccgaggacgaattagcagcagccatcgtccaacagttgccaccgaacgcgatgggggaggtggccgctcatgatgaataaattgatctttggtcgctacattccgggagactccgtggttcaccatatggacccccgggcgaaactgttactgagtttttattttattgggattatttttattgccaataactgggcgacctatgccttgctatttgcctttacattggccgctatttacctatccggtgtgaaatggtcgttcttcatcaacggcgtcaaaccgctgatttggttgattttattcaccgtcatcctgcaagtgttgtttagtgcaagtggcgggcacgtttactttcaattgggcatcattacaatcagccaacttggattgatcaacggggtctatattttttgccggttcgtgttgattatttttatgtcaacgctgttaactctaacaacgccgccactggaattgtcggatgccatcgagtatattttgatgccgctccgggcggttcgttttccagtctatgaagtggcgctgatgttgtcgattgccttacgctttgtgccaacgttgatggacgaaacggaaaaaattatgaatgcacaacgggcccggggggtcgactttggtgagggcaatatcttccaacaaatgcgtgccgtggttccgctgctgattccactgtttgtcagctcattcaaccgggctgaggatttagcaacggcaatggaagcacgtggctatcaaggcggcgagggtcgcagtaagtaccggattcttaagtggcaccaacgtgatacgtgggctaccggatgctttgcgatcttgaccgttgcattgattttcttgcgtgcataaatgaagactgattaacgtgggcgtcgcactgatggcgacccacgtttttaactggagggatattgtgaccacgcggtataaagtagttttagcatatgacggcaccaattttgcgggttttcaacgtcagccacaccagcgaactgtcgagcaggtcgtcactaaggcggtcaataagatggcgaaagatcccgttgaaccgattgtgatctacggcgcgggccgaacagatgctggtgtacatgcgtttggacagacgttgcattttgacttgccgtacgaaattaatccagaaggggttcggcgcggcctgaacagcatgttaccgatggatacaatcgtaaaggccgtttccattgtgccgaatgattttcacgcgcgttatgatacggtcggtaagcggtactggtatcgggcctatcaaaatgaatttgtagatccatttaaacggcactatacggggcattttaagttcgctgcggatattgacagaattcagcaagccatcggtgacttagaaggacggcacgatttctcgaccttcgttgcgtccggttcgcaagcacatgaccatgttcgtgagatctattcagccaaagcgtgggccttgccggatgaacgcgaaattcagtttgaattttgcggtagtggttttttatataaccaggttcgaatcatggtggctgttttgatggaaattggtcagggccggcgcgcagttgactgtattccagcattactagcggctaaagaccgtgagcaagcgcggggaacggctcctgcggctggactttatatgaaaaaagtgtattatgaacaaaatgaattacaagctgatttgataaagtattgacttctgaggcgaaattgggtagactagtcgttggtattgtttgccccacgataagccccggaaatcttattgagtgtcaaacaaacacagaaaatggaggaacacaacgtgcgtacaacatatatggctaaaccaggtgaaattgatcgtaaatggtatgtagttgatgcaaccgatgtacctttgggtcgtctttcaactgtcgtcgcatcaatcttgcgtggtaagaacaaacctacctttacccctaacgtggatactggtgataacgttatcgttattaatgcaagcaaggtcgctttaactgggaagaaagcagaacggaagatttattatcatcatactgcttatgctggtggtttaaaggaacggactgccggtgacttcttggcaaaggaacctactaaattgattgaaacttcagttaagggtatgcttcctcacaactctttaggccacaagatgggcttgaagttgcatgtttatgctggtgcagaacatacgcaacaagcacaaaagcctgaagttttggacatcactaacttaatctaaggaggaaactacattggctcaagtacaatatcgcggcacaggccgtcgtaaagattcagtagcccgcgtacgcttagtaccaggtactggtaaaattgttatgaatgacaaatctgttgaagattacattccatttgcagatattcgcaaggaattgttacaaccattcgaagtaactgaaacaactgatcaatatgatgttttagttaacgttaatggtggtggcttccatggtcaagccggcgcaactcgtcatgggatcgctcgggcattgctcgaagttgacccagatttccgtactcctttgaagcgcgcgggtctcttaactcgtgatgctcgtatgaaggaacgtaagaagccaggtttgaagaaagcccggaaagcttcacaattctcaaaacgttaatattatccaaaaacgttgttttatcaacattttctggctatatgagaaagcacctgtctatggacgggtgctttttttgttgtttgaacagaaaaaataacacaaaactaaaacatggtagggctcatgatataaaatagaccactttgttagcgtcctggctggcagcacgtgttcatgtcagtacgacttccggggtgagcgactatgcagttagcccgccttgaaacaagctaagcaagtaacgctcggttacttaaaaatggattgggccattgacggctcaatccattttaattactgacgtttagttttaccaaaagagaagacggcaacgcaaccgaggccggtatggctagtgatagtcggcccaatgtgttcgagcaaaatttcagcatcaggaaccttggctaaaatcttttcacgaacggtttgggcggcttcctgagcgtcgctagtggcaatgataatgcgcggcttggtctgatcacgtaaatcggctagtgtgttgttaactagtgtggtcagtgaccggcgccgtgagcgcaccttttgtactggacgcaagtggccgagtgggtcgacgtccatgactggcttgatctgtaagagtgatccaaccgtcgcggaggtccgtgagacccggccgccgtgataaaggtaatttaagtcatcaacggtgaaccattggtgataatagaggcggttttcagtcagccaatccgccaattgggcgatcggcataccagcatcgcgcttgtcaatggcatctagtagcatcaggccttcaccgcagcaggctgctcgggaatccacgaggtagatctcggcatctggctggtcttgtaaaagcatggtcttggcctgttgcgcattattgaaggtcccacttaagcctgatgaaaagccgaggtataggattggcgtatgtgcctgaacgtacggcttgaaaaattcaataaactggccgatattaatctgagcggtagaaggcatcacaccgttaccaatccgatgataaaagtcagtcaagtcaaagtggtgacccaaatcgtccgcgtattcctggtcgtcaatcgtgacgttcattgaaacaaaatcgacatgcttgtccttaagtagttgataaggtaaatcaacggttgaatctgttaatagctgatacatagctttctcccttaattgtacttactgttacattgtacgcttatttgggcggccatggaaaattaatacatgctgtatttttacatacagcagtaatttacggtaacaactagttggttgtcgcaatcctggtagcagcgtgaatgctgatcaagaaattgaactgggcatgtcagtaaatactggacgcatcggaaggtcagttatgggttaactgcaataatggcgtagtgactaggaccgtgcttttcagtcatggtgatgaggttcgacgactaatttgcctattcaatgaggcgctgtaagttgattgaaatcagccgatcaatggcgtgattttgctgctggcggtagggggtggccccggtttcataaaggagttgcgcctggtgatgatgaacgctgatctgttcgagttgcggaggcaatcgaagaatcgcgataccggtggtcagttggtgctgttgaattaattagctgcgcttgaatagcagtaagtgtgaggcgctggggccgtatgactgtgataacaagacgtagtggtcatagaaggccattccttgaatattgggtgggagcttgccgtgccagtcactaactgcctttggtaaaatggcgtgactcgtggtcattctgtatggcgtgccggcgctcgtcagtggatagcgggcaaccaaggtggtctgtccaggtttgaactggccgacataaagggcctgatggtgataggtcagtagtgaggcattgctcagtgttggcagtgaccagcgttgctgatagtgaacggcaatggaagtggtcgggtcgaagtgccgtaatgcggccagactaacgctcacgatagccccatgaccgtggcgatgactgcacaaccaaatccgctggtggtgagggtcataagctagaccacccacatgtggtttaccatgcaataagacagtgttgcataattgatgtcggaaacgatcctgtacatataggacagattgggttcgaccagtggcatcgtaagcggtggttagacgataacgaccggcaataacaacgccctgtggaatcatcattgtcgtcgtcgtgagttgtttagtgacgaggtccctagtcagggtggcttgtagtcccggctgaatggtggtgccttgcaacataccgattgggtcgaattttgctagtttaaccagatccggatactgacggatggtttgataaaattcggttggtgaaaaaacagcttgggtggctgttctttgaagggtggttggtgggtacggtagtgtcggtcgtacgcgactagctagaccgccgaggggatggccccaaattaacaagcccgtgattagtcctgtataaaaatgataggtataacggtgcatcgcgggtccctcctctagtttaagtgtcttcaatatagcatggaaagacaggccgcttagcggatagtgaaaggttagttaaggaaagaaactgagtggggcataattgaaaaattaacgttttacacatctgtttttaattacatttacataaaacattgaattttctaattaggaatcggataatgaacgtgttcaagctgtttagcaatctgaataaagtgtgatatcccggtgctcgccaagttaggcgagtgctggctgtcaaaaacggaggaaaatataacgatgcgaattagtgcggaaacggaacgacaatttttagaagcagtttttaaggcccaacggtttagtgccaaggatggggcactgctggcagacaccctggtcgatgcagatttacgtggaatctcatcacatggtatccagcggctggcttggtatacgcggatgatcaaggatcataccttggaaccgacgaatcaaccgaagattttgaatgaaacacctaccagtctattgatcgatgcgaaccagagcatgggccagattgcgtcggcgtttacgatgaataaactgattgaaaagactaagcaactcggtgtttcattagcggttatccgcaattcgaatcactttggaacggcgggctattattcgcgcatggcttgcaaagcgggtttgatcggtatttcaacgactaatacgcggccgttggtggtgccgacgaatgcgacagaagcttttttgggttccaacgcattagcttttacttttccagccgacccgcatcctttcgtttttgacggcgcgactgcggtggtttcaagcgggaagattcaagtgctggccaaaaaaggtgcacagattccgggtgattgggcggttgatgagcatcgtcaagtcttgcatgatgcgcagacggtggaggataacttggctaaaattgcgttttctgagaatcgtcctggtggtggggtcctgaccctaggtggccagcaggaagtcaattcaaattacaaaggctttggcaactcactaattattgagttactcacgggaattttagcgcaagggtcgctgtcggctgatacgaacaccggtaagcatgactttagtcagttcttcatgacgattaatcccgccttatttggcgatcccgaggtgttgaaggccaacgtgacgactatgtttgaccgtattcggcatttgaagcatctaccaggtactaagatcatgataccaggtgaccgggaataccggcactatgatgaaaatttggtgcagggcgtcagtattgatccacagacgttgacggaaatgcagcaagttggtgctgaatttggagtggcagtccccgcagccttgaaagcgtagtttggtgtagttgcggcaattattgtgactaaaatggggatcacataaactgatgatagtgtggctggaatctgctctggatgctggcgacactatttttggttatcacgattatgtgcggtggtgaagaccaactagctggttgggaatagatggcagttcagacaactgacgagcggctaaggttagttgctaaagcatacggaacattgttgaaattgtaatcgaaaatgaccgtttgtcagtcgttcgttgtgagaaatttagcgttggagtgcggcttttagactttaatgatttgccttgcggtggattataagttaagtcagtgcaagctactggctaaaaatattttcagaaagtggcagggaaccattttaatatctgtaaaatgatttgacacgcaaacttgctgatttaccagtatttattagcagttagcgaggatgatgacgactagcaaatcgagggtggaccaacatgtttttgttgattaatagaaaaagtttgcaaaaaccatttgacaattctattgattagccgtatattttaagtcatcaaatacacattataaattaaggagattttaatcatgacgattaataccaatttacaattgaattcgtattattattactggtttacttagtgccttggcatccactgcgaggcacgccctcgcaacggatgtgaccagtaaattttggaatgattaaaatttatggaaaagtcatatcagtgttgtgaacaaccactgtgtgacttttctgcttctgagtagcggtgtttttcgggcaccctgcgaagaattagtggactcacagttggtgtaactgtgagtcttttttattagccaaaatgagagggagcgaagttaatgcaagcatttgatgaaattgatgtattagcggtgaataatctacgagtactgagtgcggaaatgattgaacgggccggttctggtcatccaggattgccactcggcgcggctccaatgatgtgggcactgtggagccgacaattacgggtcgatccacagcagtctcaatgggctaatcgcgatcgctttgtcttatcagccggacacgggtcggcgttgttgtacagtctgctacatgtgagtggcttcaacgtgacaatgggcgagttacaacgttttcgtcaattcggcagttacacgccaggccaccctgaactgggaatcgtggatggtgtggaagccacgaccggtccactgggacaggggttagggatggcggtgggcatggccctggctgaacggcaactagcggctcagttctccgagtcaccgcagttggtggatcactatacttatgcgttagtcggtgatggtgatttgatggaaggcgtctcccacgaagccgccagctttgccggtaatcaacaattgcaaaaattaattgtattgtacgacgataacgctgtttcgcttgatggccccaccagccggtcgtttcgtaccgatgtgaaccagcgcttcgctagttatggttgggatacacaaacggtaggtgatggcaatgatttgacggcgattaatgccgccattgagcgtgccaaacacagttcacgtccaagcctgatcgctgttaaaacgacgattggatttggcgcaccacaagcgggtacgaatgcggtgcatggcaatccgttgggaacggccggtttaactagtttgcggcaacaattagggtggcaagccgcgccatttacggtgatgccggccgttgctaaacgcgcacagcaactaatcttgcaacgtggtcagcgtgcacatcgccggtggcagtcacaacgagaggttttaccacaagccgtacaacaccgtttcgaacaacagctcagtatgcgtctgccagttgacttagccaccagtttaccgatctttgatgaaggcgcccaagcttcgcggatcacgagtcataccgtcattcagaagctagccgctcagttaccaggattagtcgggggcgcggctgatttagccagttcgaataaaacgaccattgagcaggatcaattgtcgactccggtgaccccggatcagcgcaacgttgcctttggtgtccgggagtttggtatgggcaccattttgaatgggatgactttacacggtggcttgcgggtctttggtggcaccttccttgtcttttccgattacacgcgtgcggctattcgattggcggcgatgatgaagttaccagtcacttacgttttcacgcatgactcgattgcagtcggcgaggacggtccgactcatcagccaattgaacagctaatgagtttacgattgattccgaatctaacggtgatccggcccgctgacccgaatgaaacggtcgcagcttggtggcaagccatcaacgcgacggatcatccaaccgtgctcgtcttgacccgtcagaatttggcagtgctatccggatctaagactaaggccatgactggtgtggctcgtggcggttatgttctctcaccgcagcgtggccgccagccaatgggaatcttgattgcaagcgggtcagaagttgctttagcttcttcaggcccaggcgaaactagctacgttaggtgaagatgtcagtgtcgtttcaatgccgtcgatggaaaactttgcgcgccaatcaacgaattaccaagctcaggtcttgccacctcaaattcggcggcgagttgcagtcgaaatgggcgcaacatctggctgggaacgttacgttgggttagatggggcggtactaggcttggaccactttggcgccagtggagcggccgaccaagtattagccgctaaccagttcacggtagcagacctagtgcggacgtatcaacaaacgcacgtggatcttggtcaacaattgcgagtcatttagaaaggaagttagttaaagcatgattgatggacaaacggcactctttggatttatcgcgcaccccgcgcggcacagtcgctcaccgcgaatgcataatttgagttttgactactgggggctaaatgcgcgctacttggcgtttgatgtggcaccggatggattggctgatacgcttgctggaattcgtagcatgggtatcgcgggggtgaacctttcaatgccattcaaacaagccgttgtaccgctactagatggtttgacagtgcgagcgcaacggattcaagcggtcaatacgattaagaatgaagctggcaagctgattggtgacagcacggacggcgctggagtttttcaggatctcttacatcaaggtctgaacttggttgataagcacgtcatggttttaggcgcgggaggcgcaggtaaggcaatcattgcggcggctttagattatggtgtcgcgagtgtaacggtctttaaacgcaacaacgaacgctacgccggtgttcagcactggttggagcaactcagtaccacgacttcggtaccactccggctctgtgcctatgaagaccaagtacggatgcagcaagttgctcgtaccagcaatttgatcattaacgcgaccaatatcggcatgacgactgctggaacgccattaccaatctcaattatccagcaattagtcccacaacagacggtctatgatgtgatttaccaaccgctagaaacgacctttttgcgcttagcgcgtcagcaggggtgcgccacatataatggtttggggatgttgatttggcaaggtgccttggcttttgagttttggactggtaagcagatgccagttcaacaggtccgccaagatatgttagccagtattcaagcgactccgccgattacggcgcaggcttaggccttaacttttgagaattgattagtaggaggaaattattatgattattatattaaaaccagcaaccgctacggctatgcaggcaaagttagtgagtcaatttggtgcggatcacgagatcttcacgcacaataatcgaattgcaattcaaggattgcgtccagaagcacttcccgcggatgtgcaagcagccagtgaatcaatcttgacggcagttcccgcagcggtccaaagcagccgtctctttcacccagaagatacgattattaagacgctacacagtgtgattggcggtaatcaattcgtcatgatggctggcccgtgttcagtcgaaagcgctgaacacgtggaccagatggccgcggttgccaagcagggtggtgcgacgattgtccgtggcggagcattcaagccacggacgtcaccttacagcttccaaggcctcggggagacgggactccaatacttacggacggcggctgataaacatggccttgatatgattaccgaagtgatggatgatgaacacgtggcgatggtggcgaaatacacggatatttttcaaattggtgcacgcaatatgcaaaatttctcgttgcttaaagccgttggacagacccaaattccggttgcattaaagcgaggaatgtcggcaacaatcgacgatgtgctcaatgcagctgaatacattgcagctggtggtaatcatcagatcatgcttttggagcggggaattcgaacgtttgataataagtacacacgcaacacgtttgacttaggtgcagtgccagtcttgcaatcgttgacacattacccagtcatcgttgatccgagtcacgcggtcggtacctgggaactcgtgaccccgatggcgatggcaggtgtagcagctggcgccagtggcatgatcgttgaaattcatgaccagccaacgcaagctttatccgatgggccgcaagcgttaaaacccgcgacgtacttaaaaatggcgcaacaggctttccagttacatgatctgatgcaaacgtgggcgtaggatgtgcctatgacaaacattgaagtcaagacgcgagttaaacagtatcagatcaagatcatgattaacagtttacatcacctaggaacattggtaactaaggtatggtgtgcccgtcaagtagcggtggtaacggataccaatgtgggcccgtactatgcgaagctggtaactgatgaactgacggcggctggattcaaggtgcgcgtgatgacggttccagccggtgaggagagcaaaagttggtcacaagtccagtcgttaatcgatcagctgagtgccgcccattttagccgcagtgacggtgtcctcgctcttggtggcggggtggttggtgacttagcagggtttgtcgcttcgatttatatgcgcggtattgccttgattcaagtaccgacatcattattagcgcaagtcgatagttcggtgggcggtaagaccgcgattgacttaccaactggcaaaaacttagtgggcagtttttaccaaccagatttagtcgtcattgatccggcaattctggtgacgttaccgccacggatgctcgcagaaggttatggcgaaatcgttaagtgcgcagcattagttggcggtgatttttggcaatccttgcaccaaattaccagtgtggcagcgattttaccagcagcaccagatttaattgcagctagtgtggcgttcaaagcgcgcgtcgttatggcggatgagcatgaacagggtcagcggcaattattgaattttggtcatacgattggtcacgcagtcgaactattggctgacggtcaactgatgcatggggaagcggtagcgattggtctagtacaggtttgtcggttgtttgcagcacatgggttagcgccgactaatttaacgtcgacgctcaaggcacgcttaatggcggtagggttgcccacggaattaccgccgatagcgccgcaagccgtggccgcagtgatgcaacacgacaaaaaagtgcacggtacagcgctgacctgggtctacttatcggcggttgggcaaccccacctgtatcccatagcggtcacggacttggcgacttggatgggtgacttgtggtcggtgtcgtgattagacgtaagtttacaatatgcttcagttcgacacatgacggttagccgggtgggatctgaaaatttgagggagcatcagaacttttgacgtccaggttctgatggacttacatggtagattaacaatcggctttccaagtaatagttggaaagccgattgttattggttagggcgtgatgtttgtatgatcaagtcgttagtcaggagtaagttcacattgtgcgcgttaattttcatgaagcatgcattaaaatatgccagtcttgagtttaaaaagccagtttagggtcaccggcaaaagttctgatttgcgtaaacttgctcggctagatcgtccttcccccagaaatgggcactcagcccggagtcgggaaatacgggaatgagtgtctgaacctgtcaaattgtatagttgaaaaacaactagtttaccaatagcctaaaagtttcatccagagtgtgccaccaacgccccatactaatagatagaaaccaccaaggcacagattcagacgccaccattcggactgcgttatgtaacctgatccgaacataatcgaggcgggaccgttggcgtaatgggtggtcgaactgaaaatggcaccgtcaaagcctaatagtagggctgctagcattgggggggcgccggctgaaattgccacacccaagaaggcgccgtacatggcggagacgtgagcagtggcgccggcaaacaggtagtggctgtaaaagtaaacgagcatcaaagctgccaagacccatagccaactgattccttgcagggcctggcccatagtttgtgaaagccatggaataaagccaagactgttcagtttgccagccataaaaataagaattgaaaaccaaacgagtgtgttccaagccccagtttcatgtaataagtcgtcaacggataatacaccggttaataagagcaaagtgacggctatgaaggccactaaggtcgcgtctagcccagtgagactagctgagatccaaagaaagagggccaacataaaaataccgcccatgagtttttcggccaaagtcatggcccccatctgctcaagttcgttggcagcccacgcatgcgcgttgggtgtatccttaatttctggcggatagagccaataaataatagctggaacgctaattaagcaaataagaccaggtaatagagcggcgagtaaccagtccatccatgtgatgtgaatctgcattgcttgggccaaggccacggcaacgagatttggtgccatcgcggtcatgaataagccactggtggcaatattaccatggaaagctgacataatgagaaaactaccaaccttacgctgcgtaccgttttgtgggtcagagccgtatgctttagctaaagattcaataattgggaagacgattccaccggcgcgggcggtattgctaggcgtggccggactagtgacgagatcgacaccaatcagcgcgtaggctaatccaagggtctttttaccaaataatttgacgaagaccagcgcgactcgtcgccctagccccgtttttacgaagcctcgtgataggaagtaagccattgcaatcatccaaaccgtgttatcaccaaagccggccatggcatccgtcatcgaggtaaaaccaagtaagacaccaagtgtgagaccaataattgcgacaccggcaataggtaacggctgggtaatgcaaccaatgatagtgccaacaaagagagccagcatgtgccatgctaatagactgagccccgcgggacgaaatggcgcgctcagccaaataatcaaaccaattatcagcggccatgtaagttgctggtagttgacggattgtaatttggtcatcgaaaacgaccacctttctagtcaaacgttaaaatcgtctcacggtgactgctgaaactagtcagcaaatgatgctaatccggacacgatttctaaattagaattaatgcaaccctaatgtcatttttgctgcccgtgacattttatcaagcgaccaggccggttcccagacaaggttgatgagtacctgatcgatacccgcgacggtcattaatgcgcttttgatatggtcattcaaatagcctgtcagtggacagcccatgatggtcagtgtcatggtaacggtgcagagctttaggtcagcatcgtaagcaacatcgtagatcaaaccgaggtcaacaatgttcacaccaagttcaggatcgatcacggtactcagagcggctaaagcttgggtttttaaagtagattgtgtatccatactaatcatgagaaagactcctttagaccaacagcctaagcagggtgatccgcttaggctgttaatggtcggttatttaatgaatttaacttgttcgttgatttttttaatctcagcttctttacgttcgttgaagatgaccttgttcttttcaaacaagttgtcgccattcgtatcgatggagacaattaacggaccgaagtctttgacctcacacgcccagagtgtttcgggcattccgaggtctttccactgggcatcaacaatcttattgacgtgcagggcggcataaacagcattgccagcggggtagacgaggtgtaaggcgtgatatttcttgcaggcccgttcggttcccggtcccatgccgcctttaccaacgattagtttgacacgggtttgttttacgaattcttcttcaaatttttccatccgcatactagtcgttggcccgactgcgaccatttcgtacttgtcatggccgagatctttaatgatcgggccagcgtggagaattgctcggtctgtcacgttaacgggtagggggcggtgttcttcaacgagccgccgatgggcaacgtcccgacaggttgttagtgagccattcaagtagacgatgtcgccgatacgaatgtccttaatatcgtcatcagaaattggggtggttaagtggtaagttttcatgataattcgactcctttgttcagtggtaagtcatagtttagatctgcgtcaaagttgataagtccgcgccggtgtgaccagcagccggtactaacagcgacgccaattgttgatgggtgtcgggcggtattctcgacattgacacccattactgacttttgaccgccaaacccctgtggtcccaggccaatgtgattgatgccgtcttctaataagtgttcgagtttggcagcattagcgtttggattttcactatcgacgcgccgcattaaagctaatttagaattaagcgcagccgtttcaaccgatgtggcgacgccgacaccgacgagtaaaggtgggcaagcgttaatgccgtagctcgtcatgcgatccatcacgaaacggacgacgccttcgtaaccttcaccaggcatcaggactttggcagccccgggtaatgtgcagccaccgccggccatgtacacgtacattgagatgtcagtgccattaccatcaacttgcagaaaaatcgaggggatgccgtcaccaatattcataccggtattgtattcgtcaaatgtctgaacagcattatgtcggagtggcgctttttttgtcccacgataaacggcgtccttcagaatttgattgagttcgcctaatagtgggaactgcgcgccgcacttaatgaagaattgtaacgcaccggtatcttggcaacttgggcgtttaagtttattggcaagtaattggttttccatcatcatgtcgtacacgagcttttggagtggatcgacttcgatcttactgagttcttcgagtttggcagtcacatcatctggtagtcgatgactgatgagcgcaatataatcggccaaaatgtcgcgcatccgttggcccttagttgataatgttggttcggtatagtcgtatgtcattgtatccatgctggtttcctcctatcaatttacagctacattgtaagtaactgtgtgatacaaaactaaccgctactcgccgagttatgccaggtattggattgtgaaagtgatggtaagcggacaggtagccggttaaaaatgacaaaaaaataccaaggccttctgacgagtgatgccgtcgtaccttggtatgaaccaatacttgatcaaaatatcggtaagttcagttgttcgtaatcacaaaaattgttatgccattaattattgattaagcaatgtttttaattgcgcgatcttttgtttgagtgcctgatattcttgaaaatgtagtttatacatgcaaatttcacaagcactgagttgatcagtacttgtgagttgggcccagtgcttgagttgcttttggacaatggtagtttgtgtgggagtgagcggttgcttgaactggtcatattcaggacgttgcccgtgtgacaaatgttgacggtaactggaaggtgtctgaccaaaatgcttcttaaacattagattgaaggacttgacctcctgaaacccattggctaaggctagatcggcgacccttatggttgggttttccagatcgtagatggcgtgttgtagtcggcagcgggttagatattcgtaaaaattcaggccgagttccgctttgaagatgcgtgagagataggctggtgaatagtgactgatttttgccgcttcgtttaaggtaattggtcgatcgtaagcctggttaatgtaatcaatgatccggtttagtgaactctgcgtcttgggttggggataagtcatcgtgattccagtatcaaagaaatcgtgatgtagcaggttcgtcaattgaaagtacagggcgttcaagtcaaaaattggccagtcctgctgatgtaatcctagatagagttgtgccagaatttggcgaatcgtttggtagtcacggtgttggggcgtcgtcacgctgttgagtagaaaagcacctgaactgaggtcgatgccctgactagtgtagaaatcgggcagaatatgtaaacggagcgcgatacattctggggtcaaggcaaaggtggcatggccgcgattggcattgatcaagatgaggtcatttgcgtgtaattgatggcgcgtcccgtcaacattcacttcgaccgtaccttgcaataaccataagagttcgatttgcggatgccagttgtagtggtaactaccaatcatgtatgttaataagtcaaattggacggttggagtggattgaaaatgctgactaggtatcatgacagtgtcctccttaggaataactttgattagctctagcttacacgttcagaagatgcttgaacagcagtcgacaaaagaatacaaagaaaaatgacaaaaattgactagggtccgtcttaaaactnnnnnnnnnnttttcagacagtccctagtatcagttatgatggaaatataagtaatggtaactgaatgttggttgtggtcacgcttaatcaagactgaaagtgacccaggcacatcatcgttgttagactaaggatgaaatggtggagaaatagtggatacgaagataattgtcaatcatgcgctacgagcgcttttatacgaagtgacggtcaaccctaagcccgggctggtcgacccgttgtcggcgggtccccatccagacatgaacgcttttatgtttattgatagtgctttgagtctagccccctactttaatgcttgtgcagcggcgggcgtcgcgtatacggctgtcgatttgacgggtttgttcaagcaaattcggggcattggtgttcaagcggaacaaaccatgtttgcggcgaccaagggcgtgaatacccataaaggggcggtgttctcactgggcgtgctagtgacagcggcggcgtatcagttgcagcaccccgacgtcgacttagcaacgattgtgcgcacaatgctggcggggttaacggcaaatgattttaatgatttaaacacgaaggagccaacgaccttaactgctggagaacgtcaatacttaacatatggcatcaagggaattcgtggtgaagccgaggcgggttatccgaccgtgatgcaagtggcactacccgcattgagacgtagtcgtggcacgattaatcagcggttattagacacactgatggcgattgtccaggcgacggtcgataccaatctggtaaaacgggcacacgacccgcacgtcattgactgggtccacgaccaagcacaccgctacttcgatttagggggaagccgcagtgaagctggaatggcgtttttacgcgaattgaatcagatttttgtcgaccataactatagtttaggtggttcggccgatttgttgattttgacgatttttattggattgcagacagatatattagcttaataatgagtgtcgtgattgtaggtgacgacacttttttaataccaaatattaatggaaattaaatgacgattgcaatgcttagttgatgagtggtcagtgctttttagtggtgatggcatcgaaagtcgtttcagtaggttctggattaagcatttagtatgttggttgtaacgccttggttaagcagaaatagtattagaatgaacgaaaatttaataccgattataaaaaagttaactgtacctaacaattatttgcattagcgctaattatcagttatgcttatgacgatgtagaaaaccgactaccgcgatgaacggaggaaatgtgatgttaaaagtacaaaacctcaccgtggcatacagtgacacaccagtctttactgatgttgccgttaactttaacgccggcaaaattactggaatcattggtcccaacggtgcgggaaaatcaacgatgatcaaggcaatgcttggtctgatcaaatcccaaacgggaaccgtcgaatatgaaggtcgtgcgctaaaacaatttcaaaaacagattgcatatgtcgagcaacgtaaagatctcgacttaacctttccaatcaatgtttttgacgtcgttttgactgggacctatggcaaactcggacttttccgcgaaccaagcaaggcggatcgtcagcgttgccaagatgcacttgagcaacttgagttagccgatttagcacagcgccaaattagtcagctctctggaggacaattacaacgggtctttgtggctcgagccttagtccaagaagccgatatcattattcttgatgaacctttcgtcggcattgatttacagagtgagacggctatcatgacgatcttgcatcagtggcgtgatgccggcaaaatgattattgtcgtgcatcatgatttgaacaaagtttcacgctactttgatgatctcgtgattttaaatcacggtatcgttgattatggtcccgtggacgcggtctacacacccgcaaacattgaacggacgtttagtgctgatctttcggccgtcctgtttacgaaggaggaaacgcgatgatgcaatcaattacgacctttatggctgctttggggaagtatgatttcttacaaagtgcgctaattacggctattatggtcggggtcatgtcaggaattattggtagctttattattttacgaggcatgtcgatgatgggcgatgccatctcgcatgccgttttacctggtgttgcggtagcttatatgctcggtatcaacgtcctaattggtgcttcggtttttggaattctagccgctagcttgatcggattcgttgcgagccgtagtaagattaagactgacacctcaattgggattgtcttcagtgcgttttacgcactcggttttatcctaatttcattagctgaaagttcgacgaacttgcaccacatcttattcggtaacatcctcgctgtgagtgatactgatatgatgacgacgacggtcgtgttaggactagtgattttattcgtggtcttcttctacaaggaattactgattacgtcatttgatccgacctttgcgaagacttatggtctcaaggtccaactgttacattacgcgttaatgctggtcttaacgctagtgaccgtttcagcgctacaaaccgtcgggatcattttagtggtcgcgatgttgattacaccggctgcgacgtcctttctatggacagaacgactggcagtcatgcttggactgtcagccttaattggggtcttgtcctcagtggtgggcttatatctcagctacacgttgaactgggcttctggtccggccatcgtgctagtagcggctattttcttcggtatttctttcatcatctcacctaagcaggccttgttgccgacgctttggaaagggcaagcagcagcgcgacgggtgacagcatgaaaacgaaattaattgcactgattggagtcatcgcgatggttaccgggatggcagtatttctgaatcaacgccagcaaagtgccaaagcgacgaccactagtgccaaaatccgggtcgtaagtacgaactcgattctagatgatatggtgaaaaatgtgggtgggcagtacgtccaaaattacagtattgtgaagcgcggcactgacccgcatgagtatgaaccacggcccactgatattgcggcaactgccgaagctgacgtgattttttataatggcttaaaccttgaaactggcggtaatggctggtttaaaaagttagtgacggcttccaaaaaggactttgaccacgatgtttttgcggccagtaagggaattaaggtcaaatatttaacgacgaacgttaatgagccggacccccatgcttggttagatctcgccaacgggattcaatatctcaagaacatcaaccggacgttgcaggccaaggatcctaagcacgccgctgtttatcaaaagaatacggatcgctacgtggcaaaactaacaaaactgcatgagagcgctcaaaccaaattcaagcagatcccgacgagtcaacgattattagtgacatccgaaggcgcctttaagtatttctcggcggcctaccatgtgcccgctgcttatatttgggaagtgaatacggaatcgcaaggcacgccagctcagatgcggacggcgttgaagaaaattgaaggaacccaggttcgaagtttgtttgtcgaatcatccgtatcaccgaaatcgatgaataagctttcacaggagacgggaatccccgttgctagtacgatttttaccgattcgctggcagctaaaggcaaaccgggtgatacgtactactcaatgttgaagtggaatcttgataagatttatgctgggctgactcggttgtagtacttgggtctataattcggttgtgttgatgtcatgtgatataagtttgttctaaaaaggaccgtggaagttaaatcttccacggtcctttctttattttgaactgctagtttagtcttccgattcgaatgacaattccgtcattgatagttccagatcatcaagtacgtcgttttcactcagaaattgttcccaggcagccggtgtttgttcgcgggtatgggggacgattttatcatgaatattggcaatcacatcatcgagcatcttatccgcttgtcgggcgatttcagcatcgttatagcggcgtgctggcgcccggtcctcattttttcgattcagaaaatcggttgctttctccataaaaatggtaataacttgggagttgtttgcgagatagtcttttaaagtttcattatccaatgtattagtcctctctagtttgagtcgtacttctaatataccacgctaatcaggttttaactgtttcaagatcggttggcgggtaaaaagttttgtaacttgcgcagatgtttcgaattgacgccaatcaggcaatttaaacgcaggattgtaaccgcttacgaaaatgatttcacaagccgacactttagaaatagttcacaatcaaaataattttaaatgctgctacgcaggcgttttaaacaacaattatatttaaatttttcaaaaaaataatttatttttaaaaaattagcaaaaatgaaagcatttgcgttataatacttgtgagttaagtaactaagcagttggaaccacatgtgcagcacacatttttgatgaaagaaggatattgacatggataagaagcaacgcaaagtcgtaattgttggtgatggctcggtgggttcatcatttgccttttcattggtccaaaattgcgccctagatgaactcgttatcgttgacttggttaaaacgcacgcagagggggacgttaaggatttggaagatgttgccgcctttacgaatgcgaccaacattcataccggtgaatatgcggatgcgcgtgatgctgacatcgttgtcattacggctggtgtgcctcgtaagcctggtgagagtcgtttagatttgattaaccgcaatacgaagattctggaatccatcgtcaaaccagtggttgcgagtggttttaatggttgcttcgttatctcaagtaatcccgtcgatattttgacttcgatgacgcaacgtttatccggttttccacggcatcgggtcattggtaccgggacttccttggatacggcgcggttacgggtcgccttggctcagaagttgaatgttgccaccactgcagttgatgctgcggtacttggagaacatggtgatagttccatcgttaattttgatgaaattatgatcaatgctcagcccttaaagacggtcacaacggtcgatgatcagttcaaagctgaaatcgagcaagctgttcgtggtaaaggtggtcaaatcattagtcagaagggggccacgttctatggggtcgccgttagtttgatgcaaatctgccgagcaattttgaacgatgaaaatgctgagttgattgtctccgccgctttgtctggtcaatatggcattaacgatttgtacttggggtcacccgccattattaatcgcaatgggctccaaaaagtgatcgaagctgagctatcagatgatgagcgtgcccggatgcaacatttcgcagccaagatgctgaccatgatgaatgtggcatcataaaaatgatgagtaagtatgaggaggaattgagatgacactaaataaggtcaagtatcgtgattttattgcaccgttattggtgggcctgatcatttggttaagtagtcctatcaaaccagccagtgtttcgatgaacgcatggcatattctggcaatttttgtggcaaccattattggttgtattacgcggccgttaccaatcgccggggtcgcaatcattgggttgacactaaccgtgttattgggcatcgtgcctatggatacagcggttgccggatttgggagcagtacggtatggatgattgcgatggcgtattttatgtcacgtggtttcatcaatactggtttaggtcgacgtgtcgcgttggtatttgtacggctgtttgggaaacgaacgttgggtttggcatacgcactgattggcgtcgatttagtaacagcacccgcaacgccaagtaatacggcccgtgctggtgggattgtttatccaatcattcagtcgttagctgaaacgtttggctctgatcccaaggatggcacacaaagtaaaatcggttcattcttagtgttcgcagaatttcacggtgatttaatcaccagtacgatgttcatgacggcgatggcgcctaacttagttgctgtcacgttagccaagagtttacacatcacgttatcgtggatgcaatggttcttagccgggattgtcccaggacttatttgtttattggttgtgccatatttaatttataaaatgtatccaccagaaattaaagatacgcccaatgccaagcaatgggcggatgatgagctggcaaagatgggtaagatgagtcttccagaaaaaatcatgggtggcgtcttcttgctagccttagtcttatggatgttatccagctttatcggtctcgaagcttcattagttgcctttatggccgtctccttgctactcgttgctggggttctatcggtagatgacgtgctacacgaaactggtgcttggaataccttggtgtggttctcaattttgatcttcatggctaatgagttgaacaaactcggctttattccatggttgtctggcgcgattggtggtgccttgaaaggcttcagttggggcattgttttagcggcactcgtcttgttctacttctacagtcactacttgtttgctagtgggactgcccacgtttccgcaatgtacggtgccttacttggggtcgcggtttccgcgggagcgccagcaacctttgctgcactgatacttggctttactggttcgatcttcgcttcgacgacgcattatgcgaacggcccggcgagtgttctcttcggttctggatatgttactcagggaaaatggtggcagttaaactttattttaggtctcttctacctagtcgtttggggtggcattggcgccctctggatgaaagtgattggtatttggtagtctgattttaagcataaaaacaggtaccaagctgccggcaacggtcagcgttggtacctgttttcgaagaagcggattatttggatagtggtgtggcttgatcttcttggagaacccgattcgcgacggcttcatcaatgatgatgtcagtgagtaattgtccgcggagggcgccaagtaaggcttcgctcttgaacttacttttgatgatgccgaaacgacgcggcactttgagaatggcgggcattttagcgccaaagagtttgtcgtggtcggcgttcagaatgtgaccattgatgtcgtatggccgaccgtataacaggccgaccaccgcctgcggatcagcgccacccagaatggcttggcgatgttgatgccagacgggaatcgagtcaatggatgctaaggtgccaattccggcaaatagcatgtccattcggtcaaagttactgatggccggtgtaatggctggttcttgagccaatgcttggtgtgcttgatcattaaacaagtagagtggtgccgggatggtgacgtactgtgcgccgaacttagcggcggctttttgaaccaacggtgttgagccgttcgctgcgttcgttttcaggttatcacccataaactgggtgaacagtaagtcatcacgagtgctcgtttgaaaattatcgatgacgctaaggacagtgccaccccatgccaccccaatcacgttactttgaataatctggcgctggattgtttcggcggcaaactcgattacgtggcgttcatcgtcactcgtggtatccgcgtctttgataatataaatatgttcaattggaaaacgatgcttaaatttagcctccagctcactatttcgttcgatgggggtgttaatgttaattttgactaggccggttgccatggcttcgtctaagtattttgaaattagataacgactgacttggtatttctttgaaatttcagcgatgttgattttggataagtaataatcatgtgcaattccaatcaacaggcggcgatgattcatatcgtccatatcgatgacctctttatcaacctaagatttaaaattttaaaactcgtttataatattttaagtttattataccagaaaagctgactttttaaaaattataaaaatccaatctaaatttgatatttttaaaaaatggtcgtacactggggataacaaagtgaacggtattattttgagaagagaaggcagatattgatggtagaacaagatgagattttaaagttgcacgccgcccatacgggggttttggacattcattcagaccttgcagtgaccgataaggctgatttaggtaaagcatatacacctggtgttgcggtgatttccaagctgattgcggcgcatccggaattaaaggcaaaatacacgatgagtggtaaattagtagcgttgatcacggatgggtcagcagtactgggcctcggcaatattggtcccgcgggtggtttgccggtcgtagaaggtaaggcactcctatacaagaacctcgcagggattaatgcgattccgctggcgttaaatcaggtcagcgtgccagcaatggtggcgacaatcaaaaacatgtcgctctcatttgcgggcattcatctggaagatattacggcgcctaagtgttttgaactagaagcggccttgaaagatgagcttgatattccggtttatcatgacgatcaggaaggcaccgcaattgtcgtgttggcgggactgatcaatgccgctcacgtagtcggtaagtccttacggcagatgcgcatcgttgtcaacggcgtcggcgcatccgggttagctacagctcggttattagcagcggtcggtgtcaaacaactgaccttggtcgatgtttacggggtcgttacagcggatgatcagcggtacaaccagtatcaacggcatcttgccaaacagttgggaacacctgcacaactaaaggggcaaccactggcgaaggtcatggccgaccaggacgtcttcattggcttgtcagacgccaacgtcttatcagcaggggccgtccacttgatgaatcatgatccaatcgtctttgcactcgctaatccagtgccagaaatcaatccagcagtagctgagaaggctggggccacagtcattgcaacaggttctagccagtatccaaaccaggtcaataatattctggctttcccggggctcttcaagggcttactcacaaatggggtcaagcaagttgataatgcgttgcagatccaagtggctcaggctttggctaagaccgtgtcgaacccaactgcgacgacgattgtgccgagcgtctttgattcacaagtggtaccgaacgtgacggcggccgttgcagcgtacgcgcaagcacagcattaatcataggaggttgtctgatggcagcacaagttgttgaaatgcaattaaataatccgcacgagcatgcccagtggcaacaattcttaacgtcattagggattactaattttagcccgcaagaggttgaacatattgatgtgaccttaggattgatcgaggatggccaacttgttgggaccggatcgttagctggcaacgtgcttaaatatgtgggtgtctgtaataagaatagtcagccgggggcccggtttaatcaaatcgtgagtgcactggtcaatcggctgtttcaagcacagatctttcatatgatggtatttaccaaggccaagtattcagcgagttttcaacacgtaggctttaaagaattagctcattcggatgaagcggccgtattagaaaacggcgcaccggatatgacggattttgtcaaacagttgccgatgattcccaaccaagcacaacagcgtgtcagcgcgattgtcatgaatgcgaacccgtttacgcggggacaccgctatttagtggaacaagccgcggcggtcagtgatttagtttacgtcttcgtcgttgcgacagatgcgagtctattccgtacggccgagcgcgttaagctggttcaacaagggacagccgacttggccaacgttcgggtcgtcagcgggcaggactatctcgtgagtgcagcgacctttccagcctacttcttggattcagcggcgagcgcaattgaggcgcagacgacgttggacgcccggatctttaagcagcaacttgcaccagcactgcacattacgacccggttcgttggtagtgaaccgacgtcgcggacgactgcgatttataaccgagttttgcagcgtgaattaccaccggcagttgctgtacgagtgatatcgcgaacgacggtggctaatcaaccaatttcggcgcggactgttcggcaacggattcaaagcggcaacttaactgagttaaaccaactggtaccggcaacaacggcccagtttataaaaaataacctaacaacattacaagcgcgaattcagaaaggaatgaaaattgatggaaattaagacaacggcagtcgccggaaccttggaatcatctgatattcaaattatgttaatggcgggagacaacggcattcaaatcgaccttgaatcagatgttatcaaacagttcggggcacaaataaagcacgtgatcacgacgacgcttcaacaattgaatatcgataatgtgaaggtgcgcgctgtcgataaaggggcgttggactgcgtcattaaagcgcggactattacggcagcacaacgggcgttagaaaccacgacaccagcatgggaggtattataatggctgaaaatgaagaacgcttacggcggacaatgatgtttgtacctggtaataatccagccatggtgaaggatgccgggatttacggtgcggactcgatcatgtttgacttggaagatgccgtctcaatggctgaaaaggacgcggcccaggtgctggtttacgaagcgttaaaaacgcaggactatggcaaggctgaattggtcgtccggatcaatggcttagacaccaagtattacgctgatgatgtcaaagcgatggtcaaggctggtattgacgttatccgtttaccaaaagtcgaatcggctgccatgattcaaacgttggaaaaggatgtcgcggcagctgaagctgaatttgatattccagtcggtacgactcatttgatggccgcaattgaaagcgctaagggcgtgcttaatgccccggcaatcgcggcagcctcggatcgaatgattgggattgccttgtcagcagaagattatacgacggacatgaagacccaccgttatcctgatggcgcggaactggaatttgcccgtaacatggtgcttcatgctgctcgtgccgctggaatcgccgcgttcgatacggtctttacaaacatggccgattccgatggcttctaccgtgagacgcggcatattcatcaattaggatttgacggtaaatcattggtcaaccctcgacagattgcaatggtcaattcagtctatgaaccaaccaaggatgaagttattaaggcccaaaaagtcatcgccgcgattgaggaagcccggatcaagggttctggtgttatttccatgaatggccaaatggtagaccggcccgttgttttgcgggctcaacgtgtgatgagcttagccaaagtttccaacttactcgacgaggagggcaattacattgaaaaatagtgtagaccgcgaattaccagcagaatcaatgacgaagttaaattaccaaggttttgagtcaaccgaaatcggacatcctgaaattcaacgggtggcccccaaagttcacgtttcaacaggggacaacaaagtcgttgattccgttgctgacgtggtaaaagccactgtcaaagatggtatgacgatttcatttcaccaccattttcgtaatggggatttcgtcttcaatcaagtgatgcgggccattattgatgccggtattaaagatttgaccttggcgccatcctccttaacgggcgtgatgaacgatatggtgatcgaagcaattaaggccggaacgattacgaatattactagctcggggatgcggggctctcttggggacttcgtttcacacggtggtttaaagaaccccgtaatcttccgttctcatggtaatcgggcccgggccattgaacatggtgatattaaaattgatgtcgcctttctaggtgtgccgaatgctgaccgactaggaaatgcgaacgggatggctggtaaagcagtctttggttccttaggttacgccctgatggatgcgcaatacgccaaccaagttgtcttattgaccgataatattgtggcttatccaaatacaccggcctcaattaaacagacacaagtcgattacgtcgtgcaagtcgaccaagttggtgaccctgacaagattggttcaggtgcgacgcgcttcaccaaggacccaaaggaattgaagattgcccagaccgttaatgatgtgatcgtgaactcaccatactttaaaaacggcttctcattccaaactggttccggcggtgctgcgttagctgtcactcggtacttgcggcaagcaatgctcgataatcaaatcaaagcctcatttgcacttggtggtattacgaaaccaaccactgatttgctcgaagaagggttagttgacaaagtcatggatgttcaagactttgacaaaggggcggcagcatcgatgcacgccaatcctaatcaacaagaaattgacgcatcatggtacgctgaccctgataataaaggagcgatggttgatcaattggatgttgccattctgagtgcgttggaaattgatacgcacttcaatgtcaacgtcatgtccggttcggatggcgtgattcgtggcgccattggtggacatcaagacgcggctacggccaaactgaccattatctctgcaccacttgtccgtggtcggttagcgacgattgtgccagaagtaacaaccgttgtaacgccgggggactccattgacgtggttgtgacggaatacgggattgcaatcaacccccggcgtcaagacctagttaaagcactcagtcatgtcccaggtgtgccggtctatacgattgaagaattacaacaattagccgaaaagaaagtcggccaaccccaaccacttgaatttacagatcgcaccgttgccttgattgaatatcgcgatggcacgattattgatacgattaaagcggtgaaggactaaagtatattgatgacaaaaatgacccggtttattactaactgggtcatttttatttatggtgaattgaaatgagttaagcagggcagttctattgcaagtgtgacaaaattttggttttataatgaaagtgagtcttaattagcgatgctatttgtcagccggtgtgtgtcctattccgacttccggggctgggtgacaattgctggaacgcagccgacgtcgatttgagctaacgcataacccgcgtcatctcaaatacgagtcttattctaagccggaagcagaccacttccagctaagaataatttggctactgagcattgtcacccagcccctccagtctcaggcacaagcttcagtggcaccaaacatgtttcggaaattcactcgaatggcagatgaacgactaccgaacttagtgcaatttatcgctgactattttgatactgggactttaaacgagatgttagggttacattaaccactttgttgaaacgttcgattactactatggtgattccgaaatagtaagctatcacaatgtcattttctgcctggaagtcggtgtaggacgaactggctaagcatatttaccctaattcgaattttttccagcgggtttaagctggtttgatctcgtttaatcatgactcgatattttgtgattgggaaaatttaagccgatgaagtaagcaaaaaatgacgattacgagtaaaattggtcaacagaaataaatcggaacatgtgaataaataaacatctttatcaaacacgcagttaccgcaaactttcagcgccaaacgactgttatatcaacctcataactaatacttatagctaaaactgagtttgactatagctatatgggggcgctaaactaggtttataaactaaatgttatttttttcacacacttagtaagcgcttaccaacacattaattggaggttatcaacatgacagaatatcgagttgaatcagatactttaggcgaagttaaaattcctgcgaacgccttatggggtgctcagacagaacggagtcgccataactttccgactggtacgaagatgccgttggaaatgattcgggcattacttcaaattaagcgggccgcagcgattgcgaataaagaagttgaagcaatgactgctgaaaaagctgatttaatcgtggctgccattgataagttattagcgctcgacgatgaagatttgcgtaaggactttccgctggttgtttaccaaactggttcggggacgcaaacgaatatgaacgttaatgaagtggtcgcacacatggctggtaagatcaatcctgatattgaaatcttgccgaacgacgatgttaaccatggtcaaagctctaacgatatcttcccaacggcgatgaacattacggccgcagttgccgtggataagctgattgccgcagcggaacacttattagcggaattgaagatcaaacaaaagaagtactggcgggtagtaaagatcggccggacccatcttcaagatgcaacgccattaacttttggccaagaagtgagtggttgggccagtgcgattgaacatgatattgcctacttaaaacagttgaattcaacgttaggcgagcttgcaatgggtgggaccgccgttgggactggtctaaacgctgcccctcattttgctgaaaatattgctgcggcgatgagcaaattgtatgggattgaatttacggctgattccaataagttctatggtttggcccatcattctggcttaaacgtggttcacggggccatcaagaccctagcagccgatttgatgaagattgccaatgatgtgcggttcttggcaagcggtccacgggccggttatgacgaattaaacattccggctaacgaacccggctcatcaatcatgcctgggaaagttaacccaacccaagctgaagccatcactatggcagcggtacgagttatggggaatgacgtggtcgtcgatttagcttctagccaaggtaattttgaaatgaacgtttacaagaccgttttgattgatgccttccttgaatctgctgaattgttagctggaacgattaccggcttcactgaccgaatgattgctggtttgacggtcaaccaagaccggatggcagagttagtcgacagttccttgatgacggttacggcattgtcaccacatattggctatcatgatagtgcgatgattgctcaagcagctgaaaaagcggggacgacattgcgtgaagcagccatcaagtctggcaaagtaaccgcggaacaattcgatgaatggatggttccactggatatgacgaatattgatgattaagctaaaataagtattgattggcgttgaaccgttaacgtggatcaaggtggcacgggtcattgttcctagacttggaatggtggcccgtgtccagttaacgacaataataaatgagattttggttccatcctggggaataccccggacgaattgagaggagaagtggcaatcaatggctgaaaagtttacatttacaccaaccgccttagcggatctaaaaccgaactatgacgtagtgattattggatcggggggcgcgggtttgactgcggcaatccaggcacatgaattgggcctgaacccggttattttagaaaaaatgtcgaaaatcggtggtaacaccacccgggcttcatccggtatgaatgcggcggagacgaacgtccaattgcatcaccatattgttgatagttttggcgatttctacggcgaaacccttaaaggtggtggcggtatgaataaccaagcactgttgaaattcttcacggaacacagtgcgctcgcaattgactggttagcagaccacggcattaagttggatgatttgacgattactggtgggatgagtgtgatgcggactcatcggccaagttccatggctcccattggtggtttcttagtcactgagttgttgaaacaagtggcggctgaccagttaccactcttcacagatgtcaaagtcgatgaactactcgtcgaagccggcaaaattagtggcgtcaaggcaacaaccccagatggagctgtcacgattacggctggagccgtcttgttagcaaccggtggcttcggtgcgaataagaccttgttaggccagtatcgtgatgatcttaaaaactatcagacgaccaatcagccgggcgcgactggagatgggattctgttggcacaagctattggggctaagttggttgatatggaccaagtccaagttcatccaacggtccaacaggatacggatcacgcctatttaatcggtgaagcggttcggggcgaaggtgcgattttggtcaataatcaaggggctcgtttcgtcaatgaacttgacacccgtaagaacgtgacggccgccatcgaccaactgggtggtactggtgcttacttgatctttgaccgcggcattcgtgaccgggtcaaggcggttgaattttacgatcacattggcctggtaaagactggcgctgatctggaaacactggcgactgcgaccggcttagacgctgcgacgcttaaacagacggtggctgactggaatcaggcagtcgctaaccataatgatgcggcctttaaccggacgactgggatggatcgcgatattgcggcgggaccgttctactcaattcacattgcgccagctgttcactacacgatgggtgggattgccattaatccagcaacccaagtgttgaatcaggacgaacgaccgattgccggcctgtttgcagccggtgaagtggtcggcggtctccacggcaataaccggattggtggtaattcaatcgctgaaacggtaatctttggccgtcaagccggacaacaaatgttcaaatatttacaataagttattttgactaacccaaatcaatagtccatgcgcttgagtaatcggtgcgtgggctatttttgatttgggctgtagttagagaccaaagaaattagtttaaaaatcaactaatttcggttaagctggaaatataacaaatatataggaagaaagtgacaagcatggcgacgatttttacaaccggtgaaccgcaaacaatcacggcaatgctagcagcccgtgatcaacgggtcgcgtatcagcaacagttgacaacgactaacccccgggccacgattgcggcgatcaagttgaatatcccaggaccgattaagaataacgctgcactacgacggttgtttttggccggtgtccagcggtttgaagctgagttgtcgacatacacggtggcagctgattggaatcatccggcgggtaatgagcggttcttgattctgacgactgactttgcgactagcaaacggctggcggtcgcttttgaagaacacgatccgttaggtcgcttatatgatattgacatcttacaagcgggttcacagcgcgcgctgtcgcggacggatttggggctgccgaagcgtcgttgcttattatgtcaccgtgaagccaaggattgcgcgcgttcacggcggcattcagtggctgagctacagcaaaagattgcggcgatgtacatgaaggaatttggtgaacgcggatgaatacacgtgatttagattattttcgggcgttagttgattgccaaaattatacgatggtcgccaagcagtttgcggtctcacaaccggcagtgactcaagcaattcatcggttggaaaaagagtttgcagtcaaactggtgattcaagaccgtcgccatcaacagacaaatattacccgggccggtcagctgctttacaagaatgcacgccagatccaggccagtttgcaacttgctcatcgcgaaattcagagtacgttacagactgatattcgttttggcttaccaccaattattggcactttatatttccctcaaattgcggaaaagttacttcagaacgggttactgcaacagttaaaaataacggaaacgggctcagatgagctattgcgtaagttagtgcatggtgagatcaacatcgcgttattagggtcgtacttaccatttgatttgccgacagttcgtgcggttcacttaggggcacggccattcagtattatcgtgagtcctcaaaatagtttggcgaaacaagccgccgttagttttaagaatctcggtcaggcacagttcattggattggatggcaaatacgtgcacccacaagccttccgagcctattgtgactttgccggggtacatccagaagttatctaccggacccccgatatctcatgggtcaaagccttagttaaagccaacttgggcattagcttactggttcgtgatgtggttaaagcggatgatggcgtcgtatgtttggagatcaaagatcaattgccggtcagcttcaatatctcggtggtcacacgggccgggtatttaccaaccactgatgaacaacggtttattgatcaattacttaaaatgaagatttaaacgtcgcgactgagccatctgtctaagtgaacagcacgattccttgagtggttcaacttttactttgagattgacgtgtcttcacgattgtttcatttggatatatcgcaatttgtcttgattacgaaaactgcaccaccctcacagactattctgtaagggtggtgcagttttgcttaatcggtctgatcagtgtcaaccgctaatgtttcgtgcaaaatggtcagtagctgttgctgcacgggggtcagaatatgggttgttcggtagacgatgcttgtgatgaattcagggggttcaatgtccatcaagtccagtcgtacgacgtcagtacggtagtgatcgacgattttggtaaagaaaccgatgccgacattttcaccaatcaatttcattaaaacgtgagtatcgttggaacgaaagacgatgttggggcgaaagtgattccggcgcgtgagtttgttgaaggccgtattatggatgaaattactattaaagaaaacaaatttttcacgtcgtagttcgttaaagtagacccgtttacgttgtgctaacggatgttgtttggacacgtagatacagaagggctgacggtcaaattcttcggcaatcaacgtttggtaagcgagcggctccaccgaaccaagcagggtcatgtcaccgcgaccgtcccgcacagcgttacgtagccagatcgagcccccctcaatggtttcgagaccggctaatagcccttccgcggccaatcgggcaccgatttttggaaaataatggttttcaataattggcggtaatcctaaaatcagtcgattttgggatagattgtcgatttcttggtgggcgaggcgtaactcatgtaaaacgattttagcgtgttcagcaagttgcgccccactagcagtgacgtgtaacgtatttttaacacggtcacgaatcacgagtggtgccccgaattcagactccaggcgtttgattgcggtggtcacagttggttggctcacaccgaatgttttcgcaacttttgaaaaattcttttgagaaattaattcatcgaaataagctaagtcttttgtgttcatttttattcctttctaaatcagcttttgtagcgaccttatttaatatatttatatcatatcatagttttgactataacattttactggcgttacagtattacttgtaaattgataggacgtttttcctagcaatgaaaattgatgaaaatgtaaattaattaggaggccgcagtaatgacaaaaactgcaagtgaaattttaaataacccattcttaaataaaggcactgcctttaccaaagaggaacgtcaagcacttggcttgacggggacgttaccaagcaaggttcaaacaattgatgaacaggcgacgcaagcttatgcccaattcaagagcaagcctagtcgtttggaacaacggattttcttaatgaatctctttaacgaaaaccggacactattcttccatttgatggatgaacacgtggttgaatttatgccaatcgtttatgatcccgtcgttgccgattccattgaacaatataatgaattgttcttggacccacaaaatgcggcctttgtttccgtagatgcacctgaagatattgaagcaactttgaagaatgcagcggacggccgtgatattcggttagtcgttgttacggatgctgaaggtattcttggtatgggtgactggggtgttaacggtgttgatattgccattggtaaattaatggtttacaccgccgctgccggcattgacccatcacaagtactgccagttagcatcgatgctggaacaaacaaccagaaattattagatgatccattgtatcttggtaaccggcacaagcgtgtttccggcgaacaatactatgatgtgatcgacaagttcgttgctgctgaacaacaattattcccagattcattgttacactttgaagatttcggtcgcgacaatgcgcaagtaatcttggacaagtacaaggatcaaatcgcaacctttaacgatgatatccaaggaaccgggatggttgttttagctggtatcttaggtgcattgaacatttcaaaggaaagcatcaaggaccaaaaaatcttatcatttggtgccggaacggccggtatgggaattgccaaccaaatcttggatgaattgatgcaagctggtttaacagaagaagaagctaagcaacacttctacgctgttgataagcaaggtttactatttgacgacacggaaggtttaaccccagcccaaaaagccttcacgcgcaaacggagtgaatttagcaacgctgacgaattaaccaacttggaagccgttgttaaagccgttcacccaaccgttatgattgggacatcgactcagcctggtacctttactgaaagcatcatcaaggaaatggcggcgcacacggaacggccaatcatcttcccactttctaacccaaccaagttagcagaagctaaagcggaagatttaatcaaatggacggatggccgggccttagttgcgactgggattccagctgatgatgttgaatacaaaggtgtcacttaccaaatcggtcaaggaaacaacgccttgatgtaccctggtttaggatttggtttgattgcttcaacagccaaggtgctgaacgctgaaaccttgtcagcagcctgccacgcattaggtggaatcgttgatacgtcgaagccgggtgccgcggtattgccaccagttgcgaaaattactgaattttcacaaaaattagctgaagttgtggcacaaagtgttatcgatcagaagctcaacaaagaaccaattgcagatgctaaacaagcggttgctgatatgaagtgggtcccagaataccgggccatcagcaaatagtgtcggtaaaataagagaattgtaagagggtataagagcacatgggagttttatggaattcaattcaaagcgtcttagttgtcgttttgatcatgatattaggtttcgtcctacgacgagcaggttggtttgatgataagtttgctggaacaatttccaaatttatcaaaaatatcgctttgccagcatcgattttcgtatctgtgctgagccgactaactcgtgggcagttaggatcatttgcgggttacttggcttatgcatttctagccgtgattattggctacttgattgcctttgcgctagttaaaattatgcgggttcgtccaggtcgtaaggggattttcatcaatgcgatcgtcaacgccaacacgattttcattgggttacctttgaacattgcgttgttcggtgacaagagtatgacgtattttcttgtttactatattgttaataccgtttcgacatgggcatttggggtcttcttgatttcaaacgacgacccgacgaaatccaaggaaaagacgcataataagattgattggaagaaagttattccaatgccattggttggtttcttagttgcattaattttcttactgctaaatattccaatcatgaaggtatcatttgtcagttcaacgttgacttacgttgggaacttagtaacaccactttccttgatttatatcgggatcgtgttagccgacgctggtctgaagagtattcgctttgaccgtgatacgattgttgcgttgattggtcgcttcatcttgtcaccaatcatcatgattcttgtcttgatggttgctggtaacctcggtgcaagtttcccaaccttagcatcgcaaaccttgatcgttcaatcagcaacgccaatgctagccgtgttaccaatcttggctaacgaagcacatggtgacgtggaatacgccactaacatcgtgacaacgagtaccgtgttgttcatcgtggttgtgccagtcttgatgaccttgattcaatatatctaaagcttatttagaagcattccggttgagagagacggaatgcttctttttttgatcaaaactgcttgagttgaacccgattaaaatatgttaaaggtcaaaattaaggtcgatcagtcgaattctttcagctgaccgaccttaattttttgcgaaaggagtgcttgaagatacaagcttgtggcgattacgtttaagcagatgaatatgatagaaacaaatttaagtcgggacgtatgactgtggactggtcagcccggttttcagcgacggttgacaaaatttggttaagtcgtgacccataataatgcggttaaattaaaattagtgaatcttatggattattaataaatttgtttaaaacaactaatgctgtaaagcactgtcttgaaaggattcaattaggaattgatcgaaattgttagatttacttgactaattgcacaaaaattaatagaattaacaacgttgcattattaagattttgattaggaggcgtaccggatgaaagcatcacaacgattgctggttaaaaaatcagtcaatccagctaattttaataagggtggcctcgaaaagacgttgagcgcatttagtttaaccatgatgggtgttggcgcaatcgtgggttctgggatttttatcacacccggaattatcgccgctaagtatgccggtccggctgccatgctctcatttgtgattgctgcggtcgtgtgttcgttggccgcattatgttacgctgaattttcttcaaccattcccttggcggggagtgcctatacttacgtttataccgtttttggggaatttttagcgtggattcttggttggtctctgatctcagaatatttattcgcggtatcctcagtggccgtaagttggtcatcgtattttcagaatttaatgagcggctttgggctaaaactaccaacatttctgaccgctgcagctggcactgccggtgtcagcggtgctggatttaacttaattgcctttgtcgtggttttggccgtctcactgttattggtcggtgggctacaagagtcaacacgggtcaattcaattatggtaatcgttaagatcctagtgattgttctcttcattggcgtggcaattttctttgttaaacctgccaattatcatccgttcatgccccatggtgttagcggcctggtcaaaggcgcgtcgttagcattctacgcgtatattgggtttgatgcggtgtcgactgcttcagaagaagtgaaaaatcctaagcgtaatatgccaatcggaattgtcggttcgttagtcgtagcatcgattttatacgtggcaatggccgccgttctggtcggggtcgtgcattacagtaagcttaacgtgggtgatcccgtggcgtatgccttagccgtcattcatcaaaactgggcggcggggattgtgtcactgggtgccgttgtcggcatgacgaccgttttgattgtcatgttatatggtgggacccggttactgtttgcgattagccgggatgggttgttaccaaaagtctttcggacggtcagtccccataccaaagtgccggttaagagtacttggatttttggcattattgccagtgtatttgcggctgtgattccattagataaaattgcggagttagttaatattggaacgctatttgcattcgctatggtgtccatcggtgttgtcttcctgcgtcgacacgaaacgctacaacaaatcaacagttcatttaaagtaccattttatccagtgttaccagttgtctcgttcctcgcatgtgtctacctgatgcttaatttgcaggcatttacgtggcatatgtttggtatttggctggttattggcatcgtgatttactttgcctatagttatcggcactcccgtattcgagcagggttacgtgccaaagaatcaaaatcgtaattaatagtgggtgcttaccggggcgggtaagcacccattcttttcgcggctactaagctttgggatatgctataattaagcgcataattcataaggtaaagagagttgaggtggctgatgatgcagagacgttcaaacgcctatcatatcagtgtattagcggtactaatggcaatcgtgatcattcagaatattgttccgttttttgggtacattccattaccaggattgagtattacgacaattcacgtgacggttatcctggccgccgtggtcttgggaccgcgtgatggggcaattattgggggcgcatggggaattattgcgtggatacgggcgttcgtcgcaccgacgagtcccttagcaccaatcgtatttaccaatccattgatttcggtgataccccggattctcgtcggtttgatagccggttgggtctttatttggtttcagaagcggcatcaaaaagtgttggggatgacgctggcgggcgtggccggggcattaacgaacacgattctagtcttaggtttgattgggctactctatagtcatcaagcagccggcttttatcaagttaatttgagcaaactaatgccgtacttgttaacgatcgtggcctcgaatgggattccggaagcgattttagctggaattctcacaccactgatcgggacaccattactacgttttaaaaaataagtcgttaaagtgacagctagcttgaatcaattcaaatttaaaacagccacccttgaaatctcctgaatttcaagggtggctgttttaaatcgctatttaacggcttgaacttgtttctgactaataattactttgttgtgatacttatcaacgatggctggatcaggacttgtaaaggtgattaaatacgaattagtgtaacttttcgcaatggtcccggtataagtctggccttccaaaatgaacgtcacttgtgttccaatatccatgatgatgcctcttttcgcacgatagttttattaaggataacacaccagtggacgtaacaggtaaaagttcactaattaaaacgtcgccgaacttgggcccaaatccccgttgctagggctaagagactggtacccagcgttgcgagccatgactgagttgtttcgtcggtctgcgggagctcagttgtggctttggatgctggtgaggagacggcaactaagtcggcactgtcagtattagttgttgtggcagataccgtggctggcgtcgtcacacttgtttcctggtcactataatcttgaagcagactagccgtgacggccgaaccgctgtcatcgtgattaactaaccagtcagtgttagtcatggcggttgaactgaccataattgaatcactgaattggcccttaatcacgctgctctgatcgatagtgcttgtctggttcacagtggtcgtcgcacgtgttgcgtcaaccgccgtgtcggaatcactatccactgcgttatccgtgtcgttcaagtcaacgtaactagtcgttgaatcatcattaggtttcgcatgattggtcgtgtccggtgttgtatcactagttatgtcggtagtgtcagtggtcgtgttatccacgatagtttgatggtcactgatggcctcatcagccgtcgtttcatcggtaacattgtcctgtgctgtggaatcggtcgttgtaccgttgtcagccgctccctgattacgattatccgttacttgatcaacatcaactgcttcatcttcagcatccgctacggatagcaatggtgttaagaaagctaacaagtgttggcggtattgtaggatcgcgttattagccgcagcgtgaccaccgacagtccctggtaagatccaaacttcttggttggcagaatgattggcggccgctaattccaatgattgagtatatggaatgaaggcgtcgtcttgcgtgtggatcaagagtaacgggatagtgattttgctagctgcatcggttgctgataagtcatcgacactgaaaccttgttccttgatcaaacgagcgttcatcgcgaccacgattttatcataggataagaagggcaggctcgtgatggctggcagaccaacggattgaagtgcgtttgaaacggcggtgatggctttgttgtatagcgaactacctagttctggtaaggtcgcgtacccggcgtccgacacaactgctttaacggattttgaaagtccaggaactgaggctgcttctaacacggtgtcggcacctaatgattgaccataaaagacgacttgactgtcggcgccattgcgttcgtcgaccatcttaacccaattcagccagtcatacttgtcctgataaccaaacgttaagttatcaccgtcacttaggaactgcccacgttgactcggcatgaggacgttataacccatgtcataccaaatttttgaaacgtagccgatccaatcaacgtgttccgtccaaccttggccgatgatgacggtcttggtggaatcaccgttttgaatatagtaagcacggacagactgcgtcgggtcattgtattcaggcagggtccagttttctttggtaacgttatcccaccaagtaaccgttgtcggataatattcttcggccgcagcccggtcagcagcataagcgactggatcgaggccggtccacgtattggagatgtcatagcggtgctggttcatttcagtacgtaaattagagagggcttctgagccagttcccgtgaagacgattgggtagagtacattacccacgatcgtgctggcgatatctgtggggagttctttcaactcgtcaagaattgtcgtcagtttggctttggctgctgctaattgttcttggccagacggggtcgctgcttgatttgctaagtccttgatcgtattaacgacagccacaatatcactggcatctaacgtgaccgtggtggtgtccgtcttatcagaggtagtaacttttttccaggtcacactgtaagggccactttgtgtaatggtgaccgtactcttttgattgccagtcgtgtcgttggtttcgtagattaagccatgaccgctgtcactagccgcgctggtcgtcgccacactagttggcgttgccgtagcggtcgaattggtgttggtactcgtatcatcagttgaatcaatagctgaatcggtcgttgattttgtcgtggctgtcgccatatccgtgacttgagtagcgtcactcgtcgctgagctagcggcctgttcgttaccacttatggtattggctgccatcgaattagtagcgctggtcgtctgactagttactgtgccactcgcactgttagcaacctcactagcttggtcggtagctgacgctgcacttgtggcttgttcagtcgcgctagtctcagtagcgttagtactagtcgtaatttgattggtgtcagtggtagcgctgctgtcggtatttgacgtggtattactgtcttcaccagtagtcatgctacttgtcgtggttgactcggttgccgttgccccggcggcttggctgagttgactagcaacgctagctggggcgttggccgcagaagtggtcgtggcactaacgggggtagccgttgctgctaaggcgttagtcgtcagcattaacgtactaccgagccccgcaatggtaatccccgcgtaaacccaatgtttgccatctttgaacattttataatgatcaacggtggttgattgttgtgaattccttttcattatatttactcctcgtaacgttttattctattgcacgttttaaaatatagcacgacaacccaggcttgtttgcgttttcgcgggctaaacttgttaaatgaggtacttttttaataacggcatcagttgtttattgtatgaactaatttgttaactgattgagtacgatgattgatttttatgatgcgacaagctcagttattcgcgggagtcacgcgtgattttaccagcagatgccagattgcaaaatgtgaacttacaaacgaataagcgtactaatagtggccttgaaaattagcggctttgactattttgggaataaaagttgagattgattgaaatttcacttatcacttgctattatgaaaggtgaataaagtgtttccgctttcgtagggaataaattaataaaggggggaccattatgaatctcggattaagtattttatccttggcgcgctttcagttcgcgatgaccacggtgtttcatttcttctttgtgccattatcaatcggcttagccttggttgttgccatcatggaaacggtgtatgttgtcaaaaaagacatcatgtacaagcacatggcacaattttggggccgcattttcttacttagctttgccgttggtgtcgtgacagggattatacaagaattccaatttgggatgaactggtctgattattcacggtttatgggtgacatttttggggcgccactagcgattgaagcgttagttgccttctttatggaatccacgtttattgggttatggatgtttggttgggatcggtttaatgccaagctccactgtgcgtttatctggctaacgtcgattgggacgatgatttccgcgatgtggattttagcagcgaacagtttcatgcaaaatccagttggtttcatgatcaataccaagactggtcgtgcacagatgacgagctttgcagcagtcgtcaagaacgaacagctctggtatgaattaccacatgtgttgtttggggcgtttgttaccggctcatttgtggttgctgggatggcggcgtttgcgttactcaaaaagaaaaacgtcacgttcttccgcaaatcgatcaaggtcagtttaatcgttggcctggttgcttccatcggtgtgattggaatgggagatttacagacgcgttacatcattaaagaacaaccgatgaagtttgccgcaacggaaggcttatataaggattccggctcgccagcttcatgggcagttattgaagggatggatactaagaaccataaggccaactggtcgattgaaatcccgtatgtgttggatattttaagctatcataagttgtccggtaatgtgaagggacaaaatacccttaacaaggaacttcatgccaagtatgacaagaaatttggtaaggacatgaactactacgtgccaacaaagacgcttttctggagcttccgggtcatgacggtagctggtgggctcttcgcactgattgccattatcggtctatacttcaaccgtgcaaagtcaacgctgattgagcggcagcgctggttcctgtgggtactaggaatctgtacgttcttaccattcgccgcaaacacggccgggtggctgattactgaattaggtcgttatccatgggttgtttatggtttactgacgattgcagatgccgtttcaccaaatgttagtgtcgcttcgttgctgatctctaacatcgtgtacttctgcttgttcagtggcttaggcattgtcatgatcgtcttatcacggcgtgccttacaccaaggacctgatgatttgttacaagctagcgatgacgcaccgtacgatccttatggtaaggaggcgttcagtcatgagtaatctacaattcttatggtttattctggtgggcgttctatttagtggtttcttcttccttgaaggttttgacttcggggttgggatgacgattaagagcttagcccaaacacgcgctgagcgcgatgttgtgattcatacgattggcccacattgggatgccaatgaagtgtggttgatcactgctggtggggcgatgtttgcgtcgttcccaatgtggtatgcttccttattctccggattctatcttatcttattgttgattctagtggccctcattatgcgaggggtctcatttgaatttagaagccggatggaaagtgacgccggccggaatttctgggaatgggccgcagccctaggtagtttctttgctgccttcctatttgggatgatgtttactgctttggtcaaagggatgccaatcaatgccaatggcgatatgactgcccacttcaccgattacgtgaacttgttctcaatcgttggtggggttgccgtaacgttactctgctatttgcacgggttaaactttattcgtctgaagacgaccgggacgttgcgtgaacgggcgcttcagtgggccaaaccgttatactgggtcctgtttgccggtgaagttgtcttcgcaattctgctgttctttaacaccgatttctttaccaagaaacccatctcaaccacgattttagtggtcgccttagtggctttgacggtcttggcaacttggggtgtttatggaaatcatgaatggctctcatttattagcagtggtctctcactgatcgacgtggtcgtgctcctgttcaatggactattcccacgtgtcatggtggcgaacaattctgcatacagcattctgattaaagatgcgtctaattcaccatatacgttgcatctgatgactgtaatctcattatcggtattaccgattatgttgatctactttatttggagttactgggtcttctataaacggttggcatcgtaattcaaatgcagatgacgacagtatcactggtgcggtggtacaattaatttaacagcaccaacggggtcgcgaccttggccaagtgccagggtgcgaccccgttcattttaagtagggagtgatcgaatgtgtttgatccggcattatttaaactaccagggatgcgccgagcagccacgattttagggttactggccatcgtcgagggtatttgtattgtctttcaggcctactatctatcagtggcgattgttggactgtggcacttgcattcattggcgtcgatcagtcagcccatgctatggttcgcattagcttgggtcggacggcagttactggtcgttattaaaaatcgtgtgatgtatccgttagtcgaacagacgacgggtgacctgcggcgtaaagtgatgcagaagttataccggctcggcccaagttatgtggctaagactgggactggtaacgtggtgacgacagcgcttgaaggcatcgataaagttcagacatacttaatgttggttgtgattaaagtaatcgacatgatggtgatcccgtggatcattttaatttacatcgcgtggttgcgttggcgtgaggccctttttctactggcaatttttccattaattattctatttatgattattttgggctatgccgctcaagctaaagcggataagcagtacgtgggctatcaacggatgtctaatcacttcattgatacactgcgcggtttaccgaccttgaagcagttaggactgagcaaacggtacgctgacaacgtttatcaggttagtgaaggttatcgtaagcaaacgatggcggtcatcaagattgcgatgttatcgactttcgccttggatttcttcacgaccttatcgattgcggttgtcgcggtcttccttggttttggtttgattaacggcacgattacgttgctaccagcgttggttattttggtcttatcgccagactatttcttgccattacgaacatttgctaatgattatcatgccactttaaatggcaagaatgcgtttgcggatgtccagaagatgctagctttgccggtgccaactgaacgtcaacagctcggtactcagcctgtgcaatggcaaagtgatagtacgttaagcttacatgacgttgattttaagtatgatgatgatcagctggccttaaaacacattaatattgatgtgcatggttaccaacggatcgggattattggggcatccggctccggcaaatcaactttgatcaatttgttaggtggctttctaaccccggtcgctgatcagggtaaaattcaagtcaacgggcaaacagtctcgcatttgagccaagacgcctggcagcagagctttttctacattccgcaaaacccatatctgttccatgcaacgttagcagagaatatcgctttttatcagccagacgcttcacgtcaagcgattgaacgagctgctgaaaacgctggattaacggcctggattgcaacgttaccagcggggttggatacggcgattggtgaaggctcccgtggtgtcagtggtggtcaggcgcaacggattgctttggcgcgggcctttcttgacgactcgcggcgagttctgttatttgatgaaccaactgcccacttggatattgaaactgaagcggaactgaaaacgacgattttacctgtacttgataatcacttagttttctttgcgactcaccggttacactggattaatcagatggattacgtgttagtgatggatcatggggaaatcgttgaacaagggacaccgacggaattggccgcgcatgacggggcgtacgttcggttacgtgatgaaatggtaggtgcgatctaatgaaagattttttggcaacttttaaaaatgatacttgggtcatgccgtatttgcgcaagtataaaaagttactagccctgacgctgtttttgggtctaatgacattcttctgtggttcagcgctgatgttcaactcgggctacttgatcagtaaagccgcacgacacccgtataatattctgatgatttatgtgccaatcgttctaacgagagcgtttgggattggtcggcctgcctttcgctatgcggagcgaattacgagtcataactgggtgctacggatcgtgtcagattttcgtaagaaactgtaccaatccgtcgccaagcacgccgtagcgattcgccaaaatttccagactggtgatgtcctgagcattttagctgacgatattgaccatattgaaaatttatatttacggaccgtttttccaacggtgattgcctggttgatgacgctagtgattgtgattggtctgggctactttagctggtggttcgggctattgatgttgttgatgttaggattggtcgttgtggtaatgccgctatggtcggtcttactgaatggtgctcgtgaatcacgcagtcgtcagattcaacagggcttttatacgcagctgactgattcggtaatggggctcggtgattggttgattgccggacgtcaaacggatttctatgagcggcaaacccagcctatcgaagcaattgcggcacttcgtaaacaggaccatcgctttcagtggtggcgagattttacgattcagatcattttcggggtgatttgtttggcgctcttgatctggagtagtttttactggacaacgaatgcggctagttccaattggattgcggcgtttgtcctctccgtattcccgttggtcgatgccatgcagtctgttagtcagggtgttagtgagtggccaagttatcaacggtcaatcaaacgagtcaacgccttagacaccacgcctgaagatgaacacgatcagacagtcttaacggagccatttcaagtattgcgtattgcggaccttgactttaaatatgcggaaggtggtcacgcgatttttgacggtttgaatctgactttaaaagccggtgaaaagttagccctgctaggaccttccggaacgggaaagagtaccttgctcaagctgattttaggtgacctgacaccggatagtgggacggttcaattgaatgatgtgcccatcacacggttacaaaatgagcgcgcccagttattcggcgtcttggatcagcagccgtacttgttcaataccacgattatgaacaatgtgcggatgggtaacttgcaagcgactgacgaacaagttaaagccgcactagcagcagtcgagttagcgcccttgatcgacacgctccccgatggttacgagacagttgtagaagagggcggtgcgcgcttttctggtggcgaacgacaacggctcgcgctagcccgcatcttattacaagatgcgcccatcatcattttagatgaaccgacagttagtcttgatccgattaccgaggcccatttgctgaccacggtgttccgggtcttgcatgataagacgattctgtgggtcacgcaccatttggccggggtcaaccatgtcgaccaagttcgcttcttggaagatggtcaattcgatatggccggtacgccgagcgaattgtatgcgaacgcacctcggtttaaacgcctttatgatttggatcaagggcgtgatgatgcgaacaatgatcggtaatccggttgatagcagtcttcacgtgcaccttgggcttgtgaaacagacttttaattactgcgctgaatgggtattcagcctacgaatgtagtggtcatgatgaccattactgattacaccgccgatttagagcgtaaaaaggacttggtcgctgtgaccaagtcctttttatatgcaattaatcgccaggttatgatttaacctgttagtaattttgtaattgtgcccgattctgaacgtcgaccacgtaggctttcgtgcctaagcggctgagtaaggtccgtacatcattgtaattgattgagacgcaaccagccgttgcccattgattcttgacgtgaataaagaagcccgagccattatgctgaccgtgattgtccatcacaatcgctaattgatactgattgtggggcgcggccttcgtgtaatcgatcagatgctcgttcttattattggcccagtttcggttctgccaagtgttatattgccggtcatgtggatcttcaatccagtaagatttccggttgatctgtcgataggccataccactagttcttgcactggcagctttaccaaatgcgaagcttaagtgataaacgcctttgggtgtggtactgctgccttcgtgagaattgccgatgccagcggccccgatgcgacttgcggaagttagtgtattcttccagccgcgattggttttttgccaaagtttaagagtggccgtggatgagccattttgaatgaccgtcacgatttgctgagcctttttggacacgcgcattctggagacgagtgttgcttcggatggggtggcagctttggctttaactggctttaagtagccactccaaatccagccagtggccccattcttgctattgtgaacccagtagtaacgaacctttttgccgtgcatgataatatcagtttgctgagtcgttgtccagacggtgttgcgatagttcttcaaatcatgattggccctgaatgtccaacgattataattaccattagccctaaaggtatgtgatttggtatcggtcgtataataggcctttctagccgttgcccgcgttggcgtgcgatgatagtaagtgctggcattcgcagatactgaacttagcattgtgaccgctgcgatcattagtacgctccccagcaaccaattaacaatctttttcatgaaacccctcctagtaaaaatagccccgttattacaatttttatacaaacactataatactatttatctcggcggaatggataacaattttgactaaatcgcggcggtgtagggtgagtaatggttgtagctgaaaaatcagcgcgtcagagtaataggttactttgacgcgctgatttaatttgtgtattagtggttgcgaaccagtaattcagtcactagccggcgtaaagtttgttgtgtttcaccagttggtagctgatcgattaggttcagtgcggttttggtatagtgagtagccaattgttgtgcctgggtaacgccccccaaagcaatgacctgatcgcgaattgtcagtagctgttcattactgatgtggtcgccgggttggggtaattgttcggccaattgtggttcagcggtcagggcgtagataagtggcagtgaataaacgccgtcccgtaagtcattaagcaccggcttttgagttaaggcctcatcaccggcgtagtcaaggacgtcatctaacatctggtaggctaaccccatcctttcaccaatctgttgcgctagtttaacgacgcttgcgtcggcacccgcgaagtgggcaccttgttcacaactgaggctgaacagacgggccgttttgccacgagcaattgctaagtagtcatcgaccgtggtcgtcggatcgaagttatgtgccatttgatccagttcgccttggaggatggctcgcatcgccgcagtattgattttaacgtcgtcagctgtcttggcagcaatcaggacttgatcgaaatagcaggtaaacaacagatcaccggcgtaaatagcattacgttgaccgtagtcttggtggatcgttgtcacatggcggcgttctggcgattcatcaattacatcatcgtgaatcagtgttgccacgtgtagtagttccatagccgctgcgccagcacgtaaccgggccgtgttatgatccggtccaaattgactaaacaagtaaaagaagcccgggcgtaaaaacttaccacccgcagcgagtaagtcgtgtacgcggtcattaatggcggcgttatcaatttttacgttagtagctagatacggcttcagcgctgctagctcctttgcgacaagactttccggttgccaaatggtttgcatcataatcaaaataccccgctttatttgagagatggctccgggacgttttgacgccaacacttgcagccagtcacattctaaaatacaatctatattaaaggtacaaataacttgtttcgttgtcaaacaaaaggatggtgtaaatcattgaaaccaaaagtgtttcttgaatttgttgaaattaaatcattaattgcgagcgtgttaccgttcgttttggggagtatgtacgcctattataattatcatcagttacatcttggttatttattgctatttttcattgcatcttcactttttcatatggcgactaatgcgaatgataattaccaagacttcctacacgcgccacgtaatgacgacaatcaagaatttttgcaagagactaatgtggtcggtgttaaccagatttccattggtcaggcccggacgattacgtttggtttagccggaatctcattgattatcggactatggttagtaacacaaaccgggttgccgttgttgtggatggggctatattcatatgcggtcggttacttttacgctggcggtccgaagccaatttcacaaggcccgtttggtgaatttttctcgggctttacgatgggctttatgatcttctggattgccgtctttattaatacgtatgacacggcagccattacttggcagtcaacgctggctgttttaattgcgtcaggtctggccatttttgcaatttctaacattatgttagctaataatatttgtgatatggacgaggacattgcgttaggccgacacacgattttgtattatcttggcaaaccggtgatgcttcaggtatttgcatggagttacgttgctggttatgcttgtctggtgatcgcggtcttgatgggtgtgctgccaaagtttagtttactaacgttgctcagtattattccagtttggaaaaatacgcgggtcttcttgcacaaacaggtcaaacgagaaactttcacgatttcaattaaaaacgcaacgttgatttgtctttcatttatcgttttcatgggcttaggactgatttttaactagggtccgtcttaaaannnnnnnnnngttttcagacagtccctagtccttcaattaaacgagtatggctttgagaaagcgccaactaaccaagttgatactaagcagtatttttcccagcgagtccaagctggctttctgattttatggcttagggtttttcaatggtatttcacgggggtaaaaaaagcttagatatcgtgtgaaaaaacacacggtatctaagcttttttaatttacataaagatgttattcataactagttttcaaatggatagcggaagtcccattgtgcacgagcggcagtcatgatatccataacgtcagtcgttttagcaagactcgtgttgtgtaattcgccagcaaccattttttgcatgtcagcaatttcgtaattcatggcgttagtgctatcgccggctgtgatggtttcaatatggccttcgctgtcggtgaaagtggcactgtcggcacgtggataggtatcaacggtaaagtaaccattctcatacgcgacgataccgcgtttaggcattttagctcggaacgttaaggcaacggtggccagttcatcattggcgtttcgtaacgtgattgtcgaagattcatcgacgccactgctgaatcggtgcatggttgttccggtaatgtatggcttagcagtcaagaattcttccacgaaggctagggcatagacaccaatgtccagtaaagcaccgccggcaaggtcgggattaaagaagcgattagttgggtctggttctttaaaactaccaaagctagcttggatcattttcagatcaccaagatgacgttctgccgcaaaatcatggagcttctcgtataatggcatgtgatacagggtcatcgcttccgctaagataaggtggttgctagcagccacttccttggcgattgcgagttgggtactagacattgtgatggccttttcactgaggacgtgtttgccagcacgtaaggcgggtaaaatcgtgtcaatgtgataattatggggcgttgccacgtaaacgatgtcgacttgttcatcagccagtagctcgtctaaattaccataagctttgggaatgttgtgttcggcagcaaaggcgttagaacgtgtttggatacnnnnnnnnnnagattctaaacacgttcttagctttttcctgcgaacgtgagcaaacggcgtagatttctccgtcaggttgatcaaaatatttaacgaaactgtgcgcgatgttaccaaggccaacaatggcccagcgataagttttcgacattataggttcctcctaggattaatcgaatgtgaccacttacattttagcaaaaaaataaggaattggcgcccaataatcatgtaaaattaattcaaaagtcggtaaaatagagtgtaatatgaccgatgctcattgcgatttaggcttacttagaattaaaacatgttggttagttggattcttattcgtcagcacgtgcgcgtcttatgccgactttcggggccgggtgacaattactggaacgcagccgacgtcgatttgagctaacgcccaacccgcgtcatctcaaatacgagtcttattctaagcccgtttacactaactcgcactttttacagttggcctaagctggcagcttttgaactaagaaaccagcatgttttaatcctaattcatgataaatgaacaggtgtaatctgtaaggcaattaccagaaaggaggcggctatgatggcgggtaagcggcgaaaatcgcgccggaagcaacggacaaagacacaattatttgtgaagaagggccgccttcagtgggtcaatatcttattagtgttggcggcgatggtggggatggtttggtatattcagcataattgggcggttaagtcgcgggttacggcgacagcacctacaacaacgcatgcggcatttattaaaaagctagtaccagctgcgcaacagcttgatcagcaataccacgtgctggctagtatcacgctaagtcaggcgattttggaatcggattggggacaaagtaccaatgcgacagagaataataatttatttggggttaagtccacgtcgggacggctcatgacgacgcaggagtattatgacggggcctatcatacggtcaaacggcgcttcgccgtttatgatagctggcacgcttcgctggtcgatcatgccaagaaattggcgtacggaacgacttgggattctcagcactacgctgcggtgattaaggcaactgattatcagacagctgcgcaagcattgcagacggctggatatgcgactgatccaagttatgcacaaaaattaattaatattattcaaaaatatgacttacaacggtatgatagaaagtaatgaaattaatagcagtatttcaatgtcgcttataattctaggagggtactatgcgagaacttgaagaacgcattttgaaagatggccgggtacttcccggtgaagtattgaaagtggacggctttttgaatcaccaagttgatcccgacctgatgtttgccatgggaacggaatttgcccacttgtttcaagatgcgggtgtaacgaaaatcttgacggttgaatcatcaggaattgcgccggcagtcatggcggggttagcaatgcacgtgcccgttgtgttcgcacgtaagcacaaatcagtcacgttaattgatgatttatatacagccgaagtttattcttacacgaagaagacgtctaaccacatctcgattgccaagaagttcttacaggcggatgaccaagtcttgttaattgacgactttttggccaatggtcaggcggttcaagggatgtttgaaatctgtgataaagcgcacgtaaaaattgcgggtgtcggtattgtgattgaaaaagtcttccaaacgggtcatcaactgattgctgatcggggtgtccgtttagaatcactagcacagattacgtcatttgatggtgaccgggtgcactttgcatcggaggacacccaggcttaagttaagaaagcgggggattgtgatgcacattgacatggggatgctagtccttattttcatcatcaactttgcttacattacgttaaacaccgtacgttttttgcttgtaatgcggggttatcggtattttgcagcttttgcaagtgtcattgagattacgatttatgtgctaggattatcattggtcttaaatcgtctcaataatccgatcaatttagtcgtatacgcgttaggttacggtgtcggggtgtatgttgggatggtaattgaagatcgattagcgttagggtatacaatgatttcagtcattttacctgatcccaagtcgtcgttaccgggagtgctccgtgaaaatggctttggagtcacacaacacgctgcttatggtctagaaggtgagcggctagaactagaaattttggccccacggaagaacgaacggcggctgtatggcctgattaaagacgcggcgcccaatgcgtttgtgatcgcgtatgaaccacgctacatctccggtggcttttggctcaagcgagttaagcgacgcaatgctcgccgaaaaaagcagtgataaacttgcaactgtgcgtgtcagcaagtatgattgttacaggataatgagcgttaaaataattcaataatcagattataattatttaaagcataggaaagtagggactgaagtggacaactcgattttaaacccaggtggtacgcttggcattattggaagtagtactaatggtgttggattagtaattgccgcgcgtaatgctggcatcaatgtcggggtatacggcgataacgaaaatactgagaccatggaactggcagattttcgcgttgtcggggccctcaatgatcaacaacagttacagaacttcgcagaacgttgtgatatggtgacttacgagtcggaaaccattgatgcgtcggtcattaattttttggcggcccatacccgggttccacaaggcgccgatgcgcttgagattacacaggaccgctctttggaacgggcgtttttcagccaacttaacttgaatgtagcaccgtcagcgacaattgtcagtttggatgatgtctatcaatcgatcgggtcaattggatatcctagtattttgaagccgattcaaaagggcttgggtcaaaatcggcaactggtcattaagacgcagacggatattgtcaaggcggctgatctgttggattggggcacatacttgttagagtcattgattccatatgataaggaactctccgtttttggcgctaagagtggtgatacgacagctttcttcccaaccgttgaaaaccggtatcgtaatcatgagctagttgcctcgattgtgccagctcaaattgattcagctgtgaatgacgaaatgctgcggatcacaaaggaaattagtgataacttgagttatacgggtgtctttgaagttgccttcttcttaacgaagagtggtaatttgtacgtgaagcggattgtccctgcgatgcatcaggcgggttatgtcttcgaacgtgctacgaatattagtatggcagaacaacacttgcgagcaattgcgggactgccgttaatgccagtcaagcagttgatgcccgtggttgctgcttactttacaccggctcaggagagtggcattcgcacgcagtggcagattaagacgaactggttctttaatttctatcaccgaacgttgttacaagcgcaccgggcaccagtcgctggccacgtgctagtcgaagcaccaagtgttaaagaagcactcgaacagatcgaagacacaagtatttggcagtttgggcaaacgacgccggctgataatgaacctgaagctgagtagtgtatgatcagaacctagttttacggattattacggttaaactaatcgtactgttcgcaccgggtgaccagctattatgggtaaccgtcgtgaataaataaagttcgaaatccaattcattttgtgaattggatttttttagcggttggggagaagccagccaaatggcgagatacggttatctgagggggaatcgttgagattggcgtggcgggtattttggttagaaattgagggagtctcaaaattacttaaagttacgcaatattgccgtcaattcgtttcccgtgaatagtagaagttgtaaaattaacataggtgtcactgacaatggaaaaaccgcgatttttgtatgagatgctgaccttaaagtacagcaatcacggccaaaatttgctataatgtttggtgactgatttttagaaagggtggcgaacagcgtgtcgaaagaaagcctattggcaggaatgaatgacaagcagcaagaagccgttttagacacagaaggaccgctactaattatggccggtgcgggctcggggaagacccgtgtattgacgcaccgggtagcttatttaattgaagagcaaggggtcaacccctggaatgttttagcgattacgtttacgaacaaggccgcacgcgaaatgcgtgaacgggttggtaagctgttaggtgaatcggcgcaggaggtctgggtctcaacgttccatgccctgtgtgtccgaattttacgacgtgacattgaacaaatcgggtataaccgagcgttcacaatcgccggcactagcgagcaacggaccttagtcaaacgaatcttgacggaacaaaatatcgattcgaaaaaatttgatccgcggtcaatcttatccgcaatttcaaatgcgaaaaatgacttacaaacgccggagatgtataaagaatcggctgccagtccctttgagagtgtcgtggcagacgtttatttgcaataccaacgtgaattagcggttgatcaagccgttgactttgatgatctgattatgctgacgattcaattattcaagcagaatcctgaaacgctggcgtggtaccaaaacaaattccattatattcacgtggatgaatatcaagatactaataatgcacagtatacgttagtcaacttgttagctgacaaatataaaaatttatgtgtagttggggatgcggatcaatctatctatggttggcggggggccaacatggaaaatattctcgatttcgaaaaggattatccgcaagctgacacggtgatgttggagcaaaactatcgttcgaccaagacaattttgtcggcggctaatgcagttattaacaataattcaacgcggcggccgaagaaattatggactgtgaatgaaccgggtgacaagatttcttattatcgtggtcagagtgaaagtgatgaaactcactttgtcattgccaagattcaagaaagcatgcagcaggacaaaatggactacggcgattttgcgatcctttatcggacgaacgcacaatcccgggtaatggaagagtcactcgttaaggcgaacatcccttatacaatggtcggtggtaataagttctatgaccgtaaagaaattcgggacgtcttatcctacttgactttggcagtgaacgatcaagattcaatgaactttgaacgggtcgttaatgaacctaagcgcggcattggtcaaacgagtgttgaaaaattgcggttgttcgcggatgaagcgggttattccatgttggaagcagctagcaatgttgacatggctaatggcatttcagcacgagcgaagggtgctttagcgaagtttgcagcgacgatgaatgaattgcgcgctatgcgggaatacttatccgtgacggatttaacacaagagattcttgaccgaacgggttacatgaaggcgttgaaagatgctaaggcaacgaaatcgttagaggcacaagcccgtatcgaaaacattgaagaattcttgtctgtcaccaaacaattcgatgatagttatcaacctgaagatgaagatagtgacaaattcgtggacttcttagcggatttagcactggtttcggatgtggataacgttgaggaagaaccccaagccgtgacgctgatgacgttacatgcagcgaaggggctagaatttccggttgttttcttgattgggatggaagaaggtatcttcccactgtcccgggcaatgatggatgaagacgagctggaagaagaacggcggttagcatacgttgggattacgcgggctgagaagaagctgtacttgaccaatgcatactcacggatgctttacggtcggcggcagaataatccggcttcccgtttcgttgaagaaatcgaaccagaattactcaaaaatgaaaatacgttggatggtgcaagtagcactggtcctaaagtcccatttggtgcggatcgtgaacggcgtgcttttacaccttcatataaaaagaatccagtggggacgcgggccacggtcaagaaggctagtggcacgggtgctgacaagaatagttggtcgatcggtgataaagtcaagcatcgtaagtggggaaccggaacggtcgtgaaggtctccggtgctggtgaagatgctgaactagacattgctttcaaatctgaaggaatcaagcggttattagccgcatttgcaccgatccaaaaagtacaggactagttaggaggactggctgatggcggacaaacccaacacaatgacggttgagcaggcggctgatgaagcggctgctttacggcaaacgttaaatgaatggcgtcggcagtactatgacgaagatgcgccgaacgttgaagatagtgtgtatgatcaaaagtatgaacggttggtcgaactcgaacaaacttttccacagctcgttacaccggattcaccgacgcaattagttggtggaacggttaaagcaggctttgataaagtgacccatgagattccgatgttgtcattgggcgatgtcttttcacaagctgagttacaagagtttgttgatcgcttggaacaaaacgttggtcatccagtcgattataattgtgagttgaaaattgatggtttagcgctgtcgttacgttacgaagatggggtgctcgttcaagggtccacgcggggtaacggtacggttggcgaagatattacggctaatattaagacaatcaagtcgattccacaacggttgacccgaccactgacgatcgatgtacgtggggaatgttatatgcctaaggcagcgtttgctgccttgaatgaacgccgagaagcagcgggagaaccagtctttgcgaatccacgcaatgctgcggccggtacgttacggcagctagattcacgagtcgtggcggaacgacagctcagcacgtttatgtataacattgccgactatgaaccgttaaccgcccgtacgcagagtgacatgttaacggagttcgcagatcttggttttgccatcaatcctgactttaaggtggcccattcgatggccgatgtctttagttacattgaccattatcaaaatgaacggccagaattagcatatggcattgatggcatcgtgatcaaagctaacccgttaccgctgcaacgctcactaggagcgacagtcaaggtgccacgatgggcgattgcctttaagtttccacctgatgagcagccgacccttttaaaggatgttgaatggaccgttggccgtacaggagtcgttacgccaactgcggttatggaacccgttcaactagctgggacgacggttacgcgggcttcgttacacaatcccgattacgtggcggccaaagatgtccgcatcggtgatacggtcttgctacacaaggctggcgatattattccggaaatttcatcggttgatttagccaaacgacccaaggatgcgcaaccattagttattccaaccacgtgtccgtcttgtggggcgccgctggttcatttggaagacgaagtggctttacggtgtattaacccgaaatgtccagcacaagtccaagaagggctggttcattttgcctctcgcaatgccatgaatatcgatggcttgggaccacgaatcattgcgcaactctatgcaaatcggctggttagtgacgttgctggtttgtaccgattaactaaggcacaactgttaacattagataaaataaaagataaatctgctgaaaagctcttgacagcaattgaccgtagccgtgataattcacttgaacggttattgttcggtcttggtattcggcacgttggtgctaaagtggcgcggttaatcgcgcagcattttgggacgattgaggcgttgatggcagctagccaagaagagattgcggcgatcgattcgatgggcgatgtgattgcgaacgcagtggttcaatattttgagagcgacaaagttcatacactcatccgcgaattgcaagcagtcaacgtgaataccacttatcaaggccctagtgccaccgtggcagaagatagtaacagttggtttgcaggcaagcgggtcgtgttaactggtaagctggaaagctttacaaggccagatgcgactcaatggctacaagctcacggcgccacggttacgggaagcgtctctaaaaagacggatctcgtgattgcaggtagcgatgccggaagcaagttgcaaaaagcacagcagctggacattactgtatgggatgaagcccggttcagcgaaacaatgagggaggatgcacaagcgtgaatgttaaacgcatacgcacgattggcttagtggcagtagctgccattgttctagccgcctgcggtaatttaaagaattcgtcctttgggtcgactagtagtagcaccacaacgaccggaacgaaaacaacgaccaccactggaactgctgatagtgagttctatcaaggcgtcatcaaaaatggccgttatcggacgagtaagtcgcgaggcgtggtcgtttcgcaaaatgataacgtcatgaatttgaagagcttcgaaagtggcttattggacgtgtctaaaaaggtctttccaacgagtaagtatgtctttcaagaagggcagtatttgagctcatcgacagttgaaaattggctcggacggaaatcaagcagcaattcggagggcttgaacccagagaataacggtaagaaggatccgaatactcggaatccgatttacttacaacagcttgaagaacaagattatatggttcaaaatggtagtaagttatcgcttggcggggtcacgattggcttgggaatgaactcggtcgattattatactaaggtcgaatatggggcaacatacgaaacggacatctcaacgactgagttaacggcgcaaggtaagaagatggcgaatactgtcttacagcggttgcggcaacgctcagctttgaagaatgtgccgattgtcttggcactctataagcagtcttcgaatgatagtttagttgggggcgacatgattgcctacgcggtttctaagaacggctccacttcgatctcaaactggacgtcgttgaattggaagaattatgtcttcccagcgacctctgagtcaaagaactcaggtgcgaatagtaatgatgagtcggactttagtcagtttaagtcccacgtgcagaatttcttcccgaacttgtctggcgtaacggcgaatgctcattacaaggacaaatcgttgagtaaattaagtgtcaacatcacgactaagttctacagcgaaacggaaattatcagtttcacgcagtacttagcaacggctgctaaacggtacttgccatctggtgtaccggttgaaattacggttaagagtgccaatggtgacattcaaagcttcttagccagaacggcgaagggtagttcgtattacacccatgtctttagtgaccagggcgacgattaaacaataatattgagtaagatttgagaaagaaggaaatctgatggctgaagaacgaattaatgccgaacaagtgcaacacgtggcgagcttagccaaattggagtttacaccagaccaattagcgatgttcacaccgcaactagaaaaaattatcggcatgttcgaagaattaagcacagttgataccacgggtgtacccgttacgtcacggatgagtgatcatacgaatacgctacgtgaagacgtggcagttaagagtgatgaagcactccgggaagcattgctgaagaatgctccagaaacggccaatggcttgatcaaagtgccagcaattattgatgaaagtggggacggtgaataatgacttatttcgaccaagatctaactagtctgcacgctgacttggtagccaagaagatcagtgctacggaactagcgaaggccacttttgcgaatatgaatcaggttgaccctaagctaggggcgttcttgaatttaaatgaagaacaggccttacaacaggcggctgctttggatcaggatggcatcgacgcgaacaacgtttttgctgggattccgatggcagtcaaggataatattgtgacgaagggcctaacgacgacggcggcttccaaaatgttggaaaacttcgtgccggtctataatgccacggtggttgacaaactattagcaagcaacgctttgatcgttggtaagaccaacatggatgaatttgccatgggagggtcaactgaaacgtcggcgttccatgtcactcgtaatccttgggacatcagtcgagtgcccggtgggtcttcaggtggctcagctgtcgcagtggcttctggacaagtgccagtggcactcggttctgatacgggtggttcgattcggcaaccatcatcatttaacggaattgtcggcatgaaaccaacgtacggtcgggtctcgcgctgggggctgattgcctttggatcttcattagatcaaattggcccaatgacacggacggtcaaggataacgcggccgctttgaatatgattgcaggtaacgatgtgcatgatactacgtcatccaaacaaactgtaccagactttacggccggtttgacgggtgatatcaagggtatgaagatcgggttaccaaaagaatacatgggcgaggggatcgaccctaaagttcgtgaagtcattcaacaagcagtcaagcagtttgaagacttaggtgctacggttgaagaagtctccttaccaaacagtcgctatggtgtggctgcttactacatcattgcatcttcagaagcttcttcaaacttacaacggtttgacgggattcgttacggtttccgggctgacgatgttaagaatttggaagatgtctatgtccgtagtcgttccgagggctttggtgatgaagttaagcgccggattatgttagggaccttctccttgtcagctggttattacgatgcgtacttccacaaagctggtcaagttcggacgatgattatcaatgactttaataaggtctttgaagactacgatttgattatgggaccagttgcaccaacgccagcctttaagttgggtgacgaattatctgatccaattacgatgtatatgaacgatgtcttgacgattccagtcaacttggctgggttaccaggaatgtcagtaccagctgggtttgcagacgggttaccagttggcttgcaattaattggtaaggcgtttgatgaaagcacaatgtatcgagcgggctgtgcctttgaacaagcaacgcaagtttacaagcaaaccccgaaagtcggaggtgctaactaatgaattttgtaaccacgattggtttggaagtccacgttgaattaaaaacgaactcaaaaatctttagtccttcacccgtgcaatttggttccgaaccaaatgccaacacgaacgtgatcgactgggggtatccgggggtattgccaacgcctaacaagggcgtggtcgaagctgggattaaagcagcaacggctttacatgctgaaatcgaacatcacacgtactttgaccggaagaactatttttacccggataacccgaaggcctaccaaattacgcaacatgaaaaaccaattgcgcatgatggttggattgaaatcgaagttgatggtaaaaagaaaaaaatcggtatcgaagagatgcatattgaagaagatgccgggaaaaacacccatgaaaacgactattcctatgtcgatttgaaccggcaagggacgccgctaattgaaattgtttctaagcctgacattgcctccccagaagaagcttatgcttactgtgaagcgttgcggcaacggatccaatttacgggcgtttcggacgttaagatggaagaaggttcaatgcgggtcgatgttaacatttcaattcggccggccggttccgacaagtatggtgtgaagaccgaaatgaagaacttgaactccttcaactacgtgcgcaagtcgttagaatatgaagagcaacgccaacaacaagttctcatggcgggtggcaagatccaacaagaaacgcggcgttttgatgaaacaacgggccaaacgatcttgatgcgggtcaaggaaggtagcgatgattaccgttacttcccagaacctgatattccagcagtcgatatcgatgatgactggattgcatccgttaagaagaccattccagaaatgcctggttcgcggcgtgaacgttacatcaatgaatttggtttaactgcttatgatgcgggtgtgttgacccaaactaaggaaatgtctgacttctttgatgcaaccgttgctgaaggtgcggatcctaaattagcttcaaactacttgcaaggggacgttaacgcgtacttgaacgagcataaagttgatttgttagcgactgacttaacgccaactaacttagctgggatgatcaagatgatttcagatgaaaccatctcaagtaagattgctaagaaggtctttaaggccattatggcgggctcagaacctgtccaatgggtcaacgacaagggcttagtccaattgtctgatccggcgaagttacaaccaatcgttgacgacgtattggataataatcaacaatcaattgatgactttaagaacgggaaagaccgggccgttgggttcctcgtgggtcaaatcatgaagaagacacgtggtcaagctaacccgaaagtcgtcaaccaactattaatgacatcattaaaagcacggtagaagcgttggtcgataaggtgttgagcctcgattgatgcatgtccagcgttggagtagggatgagacgctgaacgcttgaccgtgtgagcggaggaataggaaacatgcgtaaacgggcacgacttatttataacccgacttctggacgtgaggcattggcccacgatttagttgaaattcttggtatctttgaacaagctggttatgagaccagtgcgttcgcaacgacgcccgcccctaattcggcggctgatgaagcgcgacgttgtgccaaggacgggtttgaactgattgtagcagctggtggtgatgggaccatcaatcaagtagtaaacgggttagccgggttaaagcggcgacctaagatggctattattccggcgggtacgaccaacgattatgcccgggcattgcggattccgcgcaatgatccggttgcggcggccaaggtagtcctaaagaaccagacggttaagatggatatcggccaggctggtgaacagtatttcattaacattgcggctgggggcatgttaacggagctgacctatgacgtgccatcacaattgaaatcgatttttgggtacgcggcatacttagccaagggtgctgagttattaccacgagtaaaaccagttgagatggatttgaaatatgatggtggtcattatcagggcaaggcttcgatgtttttcttagcgctgactaattcagttggtggctttgagcagttagtgccggacgcgtcattagatgatggtaaatttaccatgattattgtgaagacgagcaaccttgccaaaatgcttcacttaatgacattagtgctcaatggtggcaagcatatcaatgatccaagcattatttatgtgaagacgagcaaggttgtcgccaaaccagctgacaaggatcgcttaatgatcaacttggatggggagtacggtggtgatgcaccgatgacgttccggaatttgaagcaacatatcgaaatgtttgccgatacggatcggatccccgatgaggcaatcacggatacggatccagagttggaagacgctgagcgacactttgtctcagccgttgatcagttgccagctgcaactgaggacgacgaaaaaacagaataacttgcttaaattaccgtttaccgatacaatggtggacggtaattttttttaaagtgttgccgtcacagggacctgattgagcattgcctaacgatttaatcgtttgtcggtttagcaatgatttgtcagtggtgcaaagcatgagacagctcaaattcgcgcgttttgacactcacagtaagcaatttgaatagcatgtttaatcagtaaatgttaacgacactgccaagtgtggcagtattaatggccatatcactcgctgcccggagcagtggctaccaggcagtaactaaaaaataataagtcactaacaaagaaagcaagaggaaacaaatgaaagttaatttaccagtgcacaagggtgaagttttagacgtcactatcatggatttaacctatcagggtatgggtgttgctaaagtcgataattacccaatctttatcgaaaatgcattgccagaagaaaaaattacggtcaaggtcacgaagacgacgaagaactttgcgtttggtgatgtggaaaagattaaccaagtgagtcctcaccgggttaatcctaaagggcgcgtttatcgtcaaaccgggattgcaccactacaacacttggaatacagtgaacaattgaagtttaaacagcaccaggtggccgaattatttgcaaaggtccacatggatgatgtcgaagttttaccaacgattggtatggccaacccgacgcagtatcggaacaaggcccaagtacccgtacgacaagttcaaggacaactaacgactggtttttacaagaagaacagtcatcaattgatgccaattgaagattattatattcaagatcccgcaattgataaggctatcgtggtagttcgcgatattttacggaaatatcacgaggcagcctacgatgaattccatcatagtgggacgattcggacgatcatggtacggcgtgggtattacagccatgagatgatggttgttattgtgacgcgaacgaaacacttaccaatggctgacgtggtcacacaagagattcaagcagcgttacctgaagttgtcagtgtgattcaaaacgttaattctaagaagactaacgtgatcttagggccagttaacaacgtgttagctggtaaggccactatcgatgatcagttactgggcttgacattcgccatttcagcccaatccttctatcaagtgaacccacaacagaccgaaaagctttatcagttagccattgatcaagctggtttgacgggtaatgagacggtgatcgatgcttattccggtatcggaacgatttcgttaacgatggcccagcatgccaagcaagtgtatggtgttgaaatcgtaccagcagccatcgataacgcacggcagaatgcggataagaatggtattacgaacgcgacctttgttttggatagcgctgaaaaagccatggctaaatggcaagcagatggcgttaagccggacgtgatcgtcgttgatccgccacgtaagggcttggacgccgactttatcaagagtgccggtgaaatggcgcctaaacgggtggtttacattagttgtaatccatcaaccttagttcgagacgcccaacggtttgcagaatacggctaccatattagtgccccggtccaacccgtggaccagttcccacaaacaccacatattgaatcggtaacggtgttagaacgcgaacaataagcattttaaaactagattattaatgaaattataaaagtgtgttggttgcctgattatttgtcgggtaaccaacacacttttttactcagcttgagggctaactttgaattagaagcacaaaataaccgtttttaagcgctgatattgatttgaattcgtccgattttaatagacagatcatttagaatcggctaataaaacagtttattgataattataattattgctttaaataatttaataaataatgcgctgtaattgctgtaaactagttcactggagctgtttgagtcaaatttagcgtattaaattaaataattgtatttattggtcaaaaaacacccacaaaaaccatcaattgtattacttttgataaaagtatgtatttcatctcggtttttgaccagtttgggttataatgataaacgaaataaaccgataaatgggggagcatgatggtaaagagaagaacactgacacaggcaaaagtattagcaacagctaatcagttaattgaaagcaagggaattaacggattaacaattcgggatttagcgttagttttggatgtgcggccgcaatcgatttataattatgttgatagcttgagtgatttattagatcaggttggcctccaatttgttcaaaatgttgcggatcgtttaactgaaacaatctcagacgttgacggtgatgaggctttgatggcatttgctcaagaattccgggcggcctgcaaccagcatcgggggttggcaccgttattacttgacttaaatgataacctaagaatcccacggtctcgtaaagcaattgtgcagctataccaggatatgtttaaaccattacaactggatgattcggcgcgggtggagaataccttgtaccgttccacgttgttcggattcattatccaagagattggcggcttctttaaggtgcaggggactgaacttgatgaacggttcacgaaggttatgcagttagcgattgaccagacacacttacctgctgataaaacgaaaaaataatttaagattcagtgcggctatcttagcagatagccgttttttttataggttaaattcgccaatatttagcagtaaatggggcgtaatacaataatctttgttaaggctgaaatcaaaatcaataatgatttattgaagtagttttatgatcaatcgtaatgaaaatcttaattctgcatggtaaacgctaaattagggcgttattttagccccaggcttaaaaaatcgtttacaataaggttaaagttaattttaagggggcccaccatgtcggaacgttatttatcagcaattgaacacgggttaacgactaagcaagttgaccagcgcctgacagcgggtctaaagaatgagccgttaccgcccttaacgcggtctgttaaacagatttttcgtgataatttgctaacactttttaactgtatcaatgttttgttagccggattagtctttttgacgggaagttataagaacatgctgttcttattcgtggtcatcgtcaacacggctatcggtatttttcaggagattcgtgccaagcgccaggtcgataagctggcattattatcggccactaaggttcaagtccgccgtgacggtcaaacggtggcgattggtcaggacgaaatcgttcaggatgatttactattagtgaccagtggcgagcagattcctgtggacgggctcgtgcgggcgaccgctggattagaggtcgatgagtcccagattactggtgaggctgatccggttattaaggggccgggtgatgagctggtttctgggagtgtcatccttggtggtcacggaatcgtgcaggcaacgcaggttggtcacggcagttttatcaagcagatggcgcgagcagctaagcaaaaacggcggacgccaagtcaactgttaacgattatcaaccgaattatcaaaattttgacttttacgattattccactaggtgctggactgttcatttccactatgatgcggggtgaaagtcagaaccgggcaatcctcgggacggtggccgcgatggtcgggatgattccggaaggactggtgctgttaacgtcagtcgctttagctgctggggcgttcactttaggccggcaccaggtattggtgcgggagttacccgccattgaggcactggcccgggtcgatacgttgtgcctcgacaagactggaacgattactagtggcaagttagtttttgaacgcgttgagccgtggaaccagcatgatttaacagctgtggagcaccggttagctgcgttagtcactgctattgatgatgataatgaaacggcccgggccatcaagactgcttttggtcagccaccagtgcaagcgacagaagttcttcccttttcttcaagtcgtaagtggagtggggctgcgtttgatggtcacgcttacgttatgggcgcaccggaatttatttttaccacggtacccggcgagttacagtctcgcatcaaaacgctcgcgcaacaaggttatcgggtattagtgttagccgaagtggctgccttaacgacgcccaaaccgactcgaccgatgactttgggattaattctgatcacggatgagttgcggccacacgctaagacgacgtttggtttttttgctaatcaagacgtcgccctaaaagttatttctggtgataatccggtgacggtcgccagtattgcacaacgggctgagatcaaggacgctgatcggctggttgatatgagtcaagtggggactacccccgactatgatcagctagtgacaaattatacggtgttcggtcgagtgacgccgcaacaaaaagagcaactaattaaagcctatcagcgcaacggccataccgtagcgatgactggtgacggcgttaatgatttgttggcgctgaaacaggcggattgtagtatcgcgatggcgagtgggagtgaagccacgaagagtttggctgattttgtcctaatcgattcgaactttgatgcgatggtgcaagtgctgaacgagggtcgccgcgttatcaataatattgaacgggtcgccgcgctctacttgatcaagacgatgtattcggtcgctctgacgttgatttttattttcatgagccacagctatccgtttgagcccatccaattaacaccgatttcatcgttgatggttggtattccaacctttttcttggcgttacagcctgattatacgcgaattaccgggcgctttatgaaacaagtgatggagattgccgttcccgcggcgatctgcgtggtcggctatatcatggtcatcatggtgttaggcaataagttccagctgaatttcgaaacgaccgcgactttgagtgtgttgatgaccgggatctttagtttaaatgcgttattgattgcagcccggccgttgaaccggttcaaaattgggttagtcgtgttaatggcaacactgttcgtcctagtctttctgtttgccggccgaattttttcattggttaatctattagattggtcgttagctgtgatttacctaccactgatgatcagtgcgtatccggtgttcattgttctgcaaaatggcttaggaaaacgcgttctcagcaagatcaattggcgataatcgatcaaatttaggtgacggggccacgctgcaattacggcgtggccttttttggtgtaatcagattgctgtctcagcgtaagccacaccgttgttgaccagtcagattaaattaacagttcgatataagtatggttgataccagcatagcatgtaaatttataacagattttaataggcagcagcgtctaaaacggcttataatgaagttcagtagattaccggaatgggggcggtattgtgtggcttgatgaacaacggttaattcaacggttagtgccgcgcttgttgcgttttcggcaaactaacttctatcggattattcaacggaccttgatgttgacgttcccattcattttgattgggacgttcagtcaaatcattcaactgaccgtgttgacgaaaacggggtttattgccagtatctttcacctgtcaaaatgggtcccatactatcgttacttacactatccgtttgatagtttaacaaccttgacgctcaacggtgtggccgtagtagcagcatttggtgcggcaaaataccatgccaaactcaatcagcgcgatgaccaactagcgggattgaccgccgcgattgcgctattgatcgtggcttatcagtatacgaatcaaaatcaaattggtgtttttaacactttattgatcgggactaacggtctaacgggcgcattgattgtgggtggtttgaccggcctgctcttcaaatggttcagcaagccggttccggcacaaagtagtccgcatacggccgatatcttgacacggactttcagttcactacttccaatggccttaatactagtattggccgtgctagtgagcctcgctttgaactggctgatgattattacgtactctgctgaaagttggtcggcatttcaaaagtacgcaacgactagtcacagtctgtggctgacctttggcatggcagttgtgacgctgttgttagaaattcttggactagctggtccgtaccaagaacgcttggtgaccaacagtgcgacaatgacggccaatttgaattatgcactcacacatcactcggcgtatcacgtgccgtatccgtatacggccaacacgttgtatcacgcatttgggacgtttggcggaacggggatgttgctggccttagtgattgccatttatatcggtagcaacaatcataactaccacgtagtcgcgcggtggagtctattacctgcgctctttaatagtaatggaccgctactgacaggcttaccagttctatataatccaatctatctaataccatttgtgcttgcgcctgtcgtaaatatgggactggcggcgctggcaattgggtttcattggattccacccgtggtttatccggttcccgtgggtacgccgggaccgttgattgcctttatcggcactaacggtaacgtggtggcacttttacttggtatcgttgatttggcactatcagtggtgatctatttgccgttcatgcggttggcggaaaccattgtgcaggcggcgcaagcacaggtggggggtgctaagcatgtataatcgacctaattggcagcgacggcggcgaagtctgttagtgcttgtattaggcttactatttctgggctttttgattcagccctcataccagtggacgaaaaccaacgtggctgcgatggcaggacgccatgattcgcagatgtcaccaattattatgattcccggcagtagtgcgacccagaatcggtttgacaccttagtcaagcaacttaataaggctgatcatcgtcggcatagtttaattaagctgaccgtgatgacggatgatacgattaaaatgacggggtcgttgcgtgcccgtgataacgagccaatcatcgtcgttggctttcaaaataatcgtgacggctatgataatattaagcatcaggcccgttggttctcactggcctttaagaagttggctgccaagtatcaattcaataatttcaaagcaattggtcactcgaatggtggtttgatttatacgtactactttgaacactattttaatcgcgacgatattaaggtcaaacgaattatgaccattggctcaccttacaatttctcagaagctaatttgaatcataagacacaaatgttagctgactttattaagtaccgcgatcgattgcctaagtcagcgacaatgtattcggtcgcaggtaccgaaaactatgattcggacggtcttgttccagcgcggagtgtcgaggctggcaagtatatctatcaagggcaagtcaagcattttacagagattacggttactggtacgaatgcccagcactccgatttacctcaaaatgcgcaaattgtcacgttgattagaacttacatgttggataagccgaaacagactcgtaagggcttagtatcgacggggactgtcgaatgagcggcaacgaggttcagttgttgtggactggacagtgttcaagagtttgtgacggtggcacctgtgaggaagtttagggtgttattaagaattgtggtaaaatttggtcatggaggtggccgaaatgtccacacaatcaccagtacatcgcaatcgggtcctgactttaattcggtcttattatccgaatttaagtgtgacggaccgcaagattgctgactatattattgccgacccaattaaaacggcggctcagtcgatttcagacttggctgccgcggttggcgtttcaacggccacggtttcacggtttgtcaaacggattagttttagtagcttccgtgacttttcacgtgaactaacggcggccgaaccgattgaacaaactaatgcggaagcttttcaagatgtcgaaaaacaaacgactttcaaaggaattgcggaatcaacattcaatagtattcgtagttcgctagatcagacaagtcaggtaatgacggaagcagatctcaagcgggcggtggaattattgctgaatgctcgctcgattggcttttatggtctcgggggctccgcagtcgctgccttagatgggtatcataagtttgtgcgcaccggtattccgtgtgcccataatagtgactatgatatgcaactgatgcaagcggctcagatgaatgccagcgacgtggcagtggttatctcacataccgggcgtaatcagcaaacactacaagtgctagccaccctgacttcacaaagtgtgccagtgatcgcgttaactagcttcggtaactcgcccctggctaaggacagtaccgttgcctttatttcagttgcagaagaaattaattatcgttcggaagggctgacttcgttgattgcccagatgagtattatcgatagtctcttcttgatgactgctgttcatggcaatatcgaaatggcagaaagtcttggccgggttcgcgaggccattagtcaaacacgaacggagctttaaagctgtaggcaaaggattgatgagatgacaaagcggcaacattatcgaccagtatacgcaaaaacgcggtgggcgcggtggcgttatcgactgggctggttattagttctattagtaatcattggcagcgtttggggcggcttggcttggttacgttggcgtagtgacgctgtcgtgagtgggtttgatgtccgtggggttgctgtgtcacaaaatgacggttatttagattttgcggccttgcaaaatgatgggctcaagtttgtctatttacacgctactcaaggagctagttatacggatgatacctttgcaagcaattatgaacgaatcgttggcacaagtttaggtgttggcgtaatccatacgtttagtttttcatcgactgctgcggcccaagcggcctatttcgagaaaacggtcggggatagcatcggcaatttaccaattgcgattcaagtgcaatactacggtgactacacggaccagacgattgcggtccgaaaaagtcgtgctaagcttaaggcattagtgaccacgttgacccaggattataatcgctcctgcgtcgtatggtcaacgcccgcagttgccaagcagatcgttaagcccgcactaaaagacactgacctatggctggacacggcgaagacccaccaacagggacgacaagtgatgtttatgcattattccgatcgcgccgtttaccgccagaacgggactcgtcaagagttcgctggaattctattcaacggtagtgtgacagcgtacaataaagttgtggcgcagggcttaaattaaggcctaatccttgaataacttatttcgcaaattaaattaacagcttattagctgctaggctgactaaaaataagtcgcaagttcaagactcttcttgaacttgcgacttattttgatggcgacctattaaaatccttaggacgtcactagcgtcattaggtatttggcgataagatgacataactgcgatcatcggcttcgtcaaagagggttacaggtcgttgctcattagcccgcacctcaaggtgaaatccatattgatcaagtaagacgagcgcactcgatgagatggattcgacggtggctggtaccgagcgcccgtcgatgcgaatcatcatgttgggatcaatctccaacgtgtggtcccggtgatgcgcctcatcacgataggtccaagttcccgcgtagaaaaccgctaagtcaccgtcagcgatcgtactagggtgccgtttgtggagtagtgtactagaaagtcctgcaagtaatgataaaccaaataatattgcgccacgccgcttcactggatcaaccttctttctgaataaatctatagttaaaatataccactaaaacggcgttaacgtcacgtaataagtggattcttattaaagcctttatgtcactgttacctgcgggtaatgaacgtaatatttgatcaatttcggaagggcggtaactaattttttgaattaatttgtgttctgattggaaattactgggtgagtgtgttaatctatataatgtgattggcatttatgtgaagttttaaagtatcatttaattgtgttaccgtaaattctttataggtgttaataacatgtgttagttactttttatttttatatcctaggaggatttagttcatgaaaaatggtactgtaaaatggttcaatgctgataagggttatggctttattactggtgaagatggcaacgatgtattcgttcacttctcagctatccaaactgacggtttcaagaccttagaagaaggccaaaaagttacctttgatgaagaatcaagcgatcgtggcccacaagctgctaacgttgttcctcaataagcttagcttttaaaagggctgcccgtgtggcggctctttttttatgcgcaaaatagcgggtgacttttgatccttatggcccaacttaacggcgaaaactggtaaaatagaattataaactaaacgcacgagtaagcgccaccaatcacgactggttgactagcgccgttgagaggagtcaaatcgatgttaaaattaggaattatcggaacgaattggattacgcaacaatttattgatgctgccgctgcctctggtgaatggcaattgacgagtgtttattcccgccatgctgagaccgcgcaggcttttgccgccaagaatcatgccgatgagacttttacggatttagatgcatttttcagtcggggtagttttgatacggtctacattgcatcaccaaacagtctgcattttgcccaggctaaacaagcaatcgcctatggtaagcacgtcatcgtcgagaagccagccgtggcgaaccaacaagaatttgaacagttagatgccgttttaaaggctcaccctgatgtcctattatttgaagcagcacgccagattcacgaagttaatttccaacgcgtcaaggatcagattaaaaagttatccttagttcagggtgcgacgttgacttacatgaagtactcgtcacggtatgacgccgtcttggctggtgaagaaccgaatatcttctcgttgaactttgccggtggggcgcttcaggatttaggcgtgtacctggcctacgatgcggtcggctggttcggcatgccggaagaggtggcttactacccaaccttgattcgaacgggcgttgacggtaagggtgtggctattttacgctacgctgactttacggtgaccttgaacgttggtaagactagtaattcgttcttgccatctgaaatcaacggtctgcgcgacgctattgtgatggacaatcctgctgaacttggacaaatcacttatcaagataaggatggtcaggagcatgcgattggggcgcaacccgataccaatccaatgctggccgaggcgcgcgacttcgcaaccgttatcaatgacccaagtaatcaccagacggaatacttagcttggcagcaacttagtcgaaatgttaataaactattatttaatttgcggcagtcagggcacctatattttacgggtgaagcccctgataccgataaatagaaatgaggcactatgttagacgtatttaaaactaaatttgcggcggcggggttcaccgagttgtcgccgattcaaacggcagtggccgagccacttgcagctggtcaatcggtgttaggactcgcaccaacggggtctggtaagaccctagcgtttacgtggccaatgctcgaagcgttgcgggtcggagaaggcacgcaggcactgatcctagcgccatcacaagaactcgcgatgcaaacaaccaacgtggtgcgcgagtggggccaattgatcgatgccaaagtcctcgcgattaccgggggggctaatgttaagcggcagatggaaaagctcaaaaagcatcctgaagtaattgttgggacgccggggcggattactaacctgattgcggatgggaagatcaagcttgggcatctgaagatgatgatcgtcgacgaagccgatgaattactgacagatgaaaccttggatcagattcgtgaaattctcgacgctacatttgctgaaacgttacaattaggcttcttctcagcaaccgaaactaaaattttagatgagttgccacgctggtttggtcagcatgttgaaaaaattgatgtgcgggccattgatcagacccagggggtggttcggcaccggacgatgcaagtgggtaatcggcaccgggtggacttactgaaacggattagtcgtgttgaccatatgcgggccctcgttttcttcaataagatgcaggaactccaacatgtcgccttagaattacgacaccagcacgtgagttacgttgccttgaccagtaatcaacggcaggttgaacgtgaaaaagcgttgcggttattccggcaaggcaaagttgggctgttgttgactactgatttggcggctcggggtctagacgtgcccgaattgccagctgtgatcaactatcagctacctaaagatgtcacgacttatattcaccggagtggtcggacaggtcgcatgggtgctgatggactagtcttgacgttcggtgacgaccatgatgtccgcgactttaagaagctgatggcgacgaccgactatgaaattaagccgggttacttggttgattatcatattgttgatacgaaaccagataaagttgttccaccgttaacgttcgaccatccagaaacggctggcaacgcggctaacggtcggcaccgggtcgtgagtgctggtcacccagatgaggttaaacgagtggagacgagccggaagcggcccgctgcggcaacacctaaaaagaagaaaggtcacaataagcattctaagaaaaaagggatgcgcaagaaaaatcgtgatcgctttagcaatcagtaattgccaaaatacacaatccgtgagatgatattttacggattgttaatggcctcatagcacaactggatagggcacccgcctcctaagcggttgatcccggttcgagtccgggtggggtcatatttatatcaaactaaccgcttcgtatcagcttaaaacgttggtatgaagcggtttttgtttttggcaaaacgctaaaaaacggtataaaaggatattttggtgcacattttggtgcacattaggcgtttttgtaagatttgtgcaccgacttgtgcaccaaaccgtccatcgaacttagagccacaagggctttgctcgtctcctttttttccatttctcgtaaaaggtgcgagtaaacacggatggttgtagaataattagaatgacccaatcgttcagagatatagtaaattgagacacctttgtaaattaaatatgaagcgtgtgtatggcgcagtccgtgaaaggtaatatctttagacccaatacgttttaaaactctgtgaagcgtctgatttgcgcttgtgttgtccggcacacgtccatactgattaataaatatcaaatcaagtggattatcaattcctagttcttctaactttataatctgcagagcgtgaaaactttttaaaatatcagctaagtgatcagtaatttttattagccgcttggactgctcgtttttggtatcagcgaatccatttcgttgtaatgtatcccaggtcttattgattctcagagttttgaaatcaaaagagaaacaatcccatgttataccggcaacttcactgtaacgagcaccagtttgcaaactaaccaacgccatcagcttagttaaatgagcaaatgttaagtctgattcaagcgcgcgagtcagcttttccgcatctttaccgtctaaatatttcatttctttaggcttttctgggcgcccactaattttagtatgcgctgtaaaattgcgcttaataatgccatcatcgatagcatattggacggctgacttaatttgcacgttaactttttcggagctgctaagcgaacgagggcttcgacctacaggattagcataatcgtttagaaacttctgataatcggtgcgtgttatttcatctaaccgtttgcccgcaaaataattattaacaattccaagtgtatactgataacgtaggcgactggactttgctaaagttggctccttataagtctgataccattttaaaaagtaatccgtaaatagttgcttacctaatcttggatttataccattgctaacatcaatttcattttggttagcccattcttgggcttcacgcttagttcgaaaaccaccttgattgataaatttacgatttcctaaatcatcgtaatatgaaacacgcgcattccattttttaccacgcttattaatacttgccatttatatttcctccttaaatttcacctaggcgggtagaattttaaggacttgcaggcaacaccttctttcagttgctgagtagtaaatgaaatacaatgttagaacaacataaaaaaggcttttaatcattctaaatattagctatactagtagcaatgtgataggttaaataagaggaggaaaatgccaatgaataattctgaatttctaaagttgatggatgagcttggtattcctaaagaaaatatcattgaacagcatgaaccccaatattctcttgaggtattgcaaaacctcgaaaaatgctatggtattgacacaagcgatgtaataaaaaatcaattatcgactgagaatccattaaccattgacaaatgtgtctatgaaaaatggattgatgcgtttgaaacttttactgaatataagggtgatatgtcgctgatcgatacatgtaagaatgagttcattttgccaaatatcgattttcaagaagctgaatttattaattctgcttctttttttgtgcaataatatggttaatattaaggccatattgaggatgaaacatgagccgagaattcgccgaggttatatccactgaaatatcagaaacaattgaaatgacatgttcattgtcagataaaaagccttggtctgttgccattaaaactccttgaacagctaattgcaatcccggtgacactaatgatagtgtttgttttatagtgctatatatgttattagttgttccaggaacaatcacattttcaaatggtagtgttccataaataggttgtatctcagcttgttccagaatatttattttcccttttctcggtgaattaggaataaattcttcaacattaccatcattatctcgtttgaaaaaatgttcgtttgctgggaacaatatagccattattttaatagaagtatttttttcagaaagttgtttctttagtgcgagggcggaatcaccattttttgagaagattaagattttattgattttattttcatatgcataatgcagtgatgactctattatgtctgaaaattcgttaaccatgttagtatatattttcattgttttttcctccattgactagtgaaacataagctttaccgagatctgttgctggatgaataaatgtattttcatagtaacaaaaaacgttaacggctttttgtattgttaatttgtggagatcaagttcagtatctgttgggtaaattaaatgatgttttccatatatatgttcatttacattaatgtgagaatctggaaagcgaattggaattttgaaaggttgaaaatcaaatctgaaatattgctcttctccatctgcagctggtgttaaagcataacgatattcttttataaaagcctttccgtctgtaattacaattttttccgttattagaaaatcatttaaagcatagtcttttccgtgtgaacaaataattaattcggacaatttggaattgtcacctgaactaattggtttcatagtaggctgtgaactcgtaattttttttaaagaagtaatttcatttttgatgtaatctcttaatggaattgaggtagggattggtcctcgtttaggtttaattttaggcttcattttttgtttcatgtttttatcacctcttttatagcattaaatttaacttgatataatgcaaggctggatacgaatcaggaagttaaagataatatatcttatgaactacgctcgcatgttgcccgctaggctgtagtgggcagggtgctattttcgtttgtgattccagtaaactaacatgacgactagcgctatgaagcaaatgatgccaattgcaattactcctaattaattaaatttgacagtgttgcgtctttgatattactcataggaatattgactgtactatgtccgctcaatacatctgatgaattggattctccagttccatcctgtattttaaaaataagtggatttttgttattaactaagttaaatgcttcatatacaacatttactgactttccgggtaaaattgaaggtttttgaaaactgagatcttggtccgtaagtttagcagttgcatcgttgtacagtgcatttggatcgtcaatttcatggtcgtcagataaattttctttagtagaatcgctattttggtaaacagttaagcctaaactagcgtcttcgttatttcctgtctgaatactatcagctgagcgtgtctttttagaagtattggttatttttgctatcacaaccacaacccttttaccagtcgctgtgttatcgtcataggtcggtactttggcaacatgagtaatttcgacagttccacgtttaggaaagatcgctgttttaccgacaaactttgccttagtcttatcaatttcttgtgcttgaactttatcatgcgctgcaagaattagtttttcgtcactggttagttttccttcttgagcgtgttcagcaattttactagtgtattttttgttcagttgcgatgtggtttctttttttaggtcactatttgaacttgaagatttactgctagaattcccacaacctgcaagtaacagtcctcctaataaaacagaactgaccataataacttttttcattacaataattcctccaattttctagcttttaccgacatccgtatctggtctataagttatccgaacataatattgaaactccgtatagattgcctatcagcatatccttcagcgcgtaatacttccactaatcttgcgttcgctaggttgccgctatcattttcatagtgcgaagcctcatgcaatgctgttttaagccaatcaatgtcatcttgaagagtattgatatagacgtcagtgccgacgatacagccatgatagtgtggattgttgacttcgataccccaaaatttaagttgtggatacatatcttcaatcttttccaagtctgtcataccggtcacctacagtctacgacgaaatttcattgcttccttgaccatatttattatggcctgacgttcctcatctgatatatccgggtcaatagagtaggcaattaatttttgattctttgtcaggctatcagatgacacagaaggttccgggtcatttgtgtttccaagaagatagtcagttgatactcctagaacacttgcaactttttgaagattctcagtgcttggattttgagttttccacttataaatagcgtttttgcctaatccagcacgatcattaagttgcagcaagctaattttattcttcttagctattttttgtactcgttcaaacacagtcatatcggcattctcctaaaaatagagaattaatttagataattgtcttgacttattaagacaattatcttatatttaattcatcaagtaattaagcagcaagaaacaatagcttcaaaacgtagctttggcgagaaacggatgatgaagtaaagtttattggcttatttcgtatgcatttattatagacgattgtctagacaaatgtcaataacttgatgaataaattacgaaagggggatgaaaaaagccgtccaactagacgacttgtgcttattagctatttaccagttgctttttctaatcctgctagaacatcttggttacgctttgaaagtactgtggctttatccatgcccttcataaaaccacgccctttcaaattgttgacgattgagtcaggagttactgtcgcaccggatagaatctttgaaatgccggtttgataatttggaacactcagtaatgttgtcactaaagttttttatctctagcttctaactatttttagctagctcagcatatcttttcgacctaataaggccgtcgggcgctcgtggatggattattgatgtcagtcaccatctatgcgttgcaccttcacaactctttgagacacgttgcacttggctcagggttgccttgccaacagtggtttaggttttccttgaattcacccgattcgagttgaatattactattcaattgggcaattctaataagcacaccaattataacagaatggataaacttattcatcaataaattatgtaaaggaggagtaaaaatgccagaacaaacaatcgaagatgtcgcattggaaattgaaattaaatacaaaactgcattgagccgccacaaaatttctcaaaaagaaatggctgaaatgcttaccactaagtccgaaaaggtcacaccgccacaagttaaccgtgcaatcaaaggtggtaacgaacccaagtcaagacggattcggtcacaaatggccaaaattttaggaattcaatgaaaggaatgatccacatgaatcaaattacaccatttaattttgaaggcaatcaagtacgcacggtactaatccgcaatgagccatattttgttggcaaagatgccgcattggctattggttatcaaaatacgcgcaaagcaattcgcgatcatgttaaggccaaatatcagagggaggaacgaatcgttaccccctcaggaattcaaacaatgaccgtcatttctgaaccaggtatttatcaactagctagccaaagcaaacttccaagtgctgatccgtttcaagattggatttacgaagacgtgctcccttccatccgcaagaatggcgtttacatgactgaccagacagcctacgacattacgcacgacaaggacgcgttaggcgacttgctattgaaggcaggcagccagctcaagcaaaaggacttagttatccaggagttgaagcctaaggcggattacaccgatagcatgttagctaacaagggactggaaacaatctcaatgattgctaagaactacggttactcgacacgtgagtttaacaagttgctacatggtttaggcattcaatacaagcaaggcaaaacgtggctattgtacgcgaagtatcaagacgaaggctatacgcacgttgaaccatacgagtatacgaatagcgatggcgtcaagcaggtacgtaacacgatgaagtggacacaagtgggacaaaagttcttatacgactttttaaagtcaaagggaatcatgccattagttgaacagccagcataggaggcgaagcagtatgagtaaatgggacacgcaagcatttttgaaatctgataggttttcaaatactaaatcagaaatagaaaaaatcctgtttagcagtgatctgttgtataaggaggcctttcagataataggcgctatccaatcagatcttgaagccaaacaggaagaagaaaaggttaattaatcgggaaagcgtcccgaataatgttcgagggcatgcttatagttatcttcgaacatttcgattcctaatcgagcatcgtacgtatggtgatgagatttagccttatctttttcttcagcaatatctgaaatggtcatagcttgagcggcatatagtgccatttcatgttcgcgatgagagcttttcatatttatcacctcgattaattgaactaacaaaattatacaccgaaaggagtgaccaggatggacagtttgataagtgctttgtcgaagcttttcacgcaagcatatgaacaaggaatcgcggatgggcgtagtcaacaagctgttgatcataaaatgattggacgtaaagatttctactctgagttcggaatcaaagttgatacattcgacaagcactatcgcgacaaagaaggattcccaaagcccgaagaagacggaaaatggtacgccccagcagtcgaaaaatggttattgaatcatcaaaatttgagtaattaaaacctaggcgggtagatgatgattcaactcataaggaggaattgccatggtagaagtagcggtattaacctgggcgctgacatccgtatggtacaaacgccgtgagattagaaactggtttggaatttaggaggaaatgtaatggtaagagacacagatgcatttgttgggcttggcaataaattagttgccaatgctgacaaggcacaagcaaatgatttactaagtgaaatgaatgttgctagtttgtcaggccatcactcaatcatctggaacaagtctgaaattagtgtcggcgttatcagcacactatcagaagaagatatttcagttagcaagtgtcctggtggcggatatgtcattgattggcaagaagcattagaaatggaggaatgatcatgcaaaaagtattaattttaccactccacgaggggaaacgagcgcaaaaaaagccatcgctagtagcggctaacgatggactaatggaagagatgattagtaccaacatctactatattcaaaagcagtctcgtttgcaagtgctaagaaagcgaggacggtagttatggaagaaatcgtgaacaatcacatcaagtttctaaagcatgttatcaacagtgtttggatcagtgatggcgaatcgctggccaagttgtacgaaatgttagataagagtgaaacagaattgaacgaattacgggggttagcataaatgtttccagaagaagtagcaatggatcgttcacttgaaccagaagacgaagatgataagccaacccgtgaggaactaattgagctaggagtgttatcagatgacgaagattgatgagctagaacaaattgaaacagctattactcatgctgaacgtgatttaggcgatctaaagcaaaaagtgctaagcaaacgatcttatattagcttgcttgaacaaaaacggagcttactgattggtaatttagacgaagttgatacgcctaattatcgtttcactcgtgagaatagacattatgataaaccgtctaattggcgagtaagcgtgattgataagaaacaagccatcaaagatcttgaacggcttgatcaaactttgattgttcccagtgtcgatttaaagaaagtcaaacagtttgtcgctaatggtgttatcgatggacaacagtttaagtcaattgtaatcagtaagattgagccaaaaataaaagtgaaagctaaggaggaataaggatgaatgagaagcttaatctgatgcagaaacttaatgaggctgctaagtcaattggcgcggttcataaagacggtaagaatagctttcagaattatgaatttcaatccgaaggagctatcaaagctgcggttgaacaagccattcaaggtgttggaatccgaataattccgaattaccaagtcattaatcaatatgacaaggagagcaaacgtgggggttctaatcactttgttgatgttatggggacattcttgattaccgacggtgcagaaacagagaccgggtcaatgcctggtagtggccaagatagcggtgaaaaagcggtggctaaagcttgtacgagtgctcagaaatacttctacaaacagttgtttaacatcaccgacaaggaagatgatccagatacaactgacagtaacgcaacagttggtgaatcgcttatcaatagcgagcaaagggaccgactcgacagactgtttgaatctctggcgggtgtaacgaacaaggacaaggaattcgttgctaaagcttacctcaagaaggttggcagcattgataaactcacgcacagtagtgctaacacgctaattgagatggtcaccaataaattaaattcttacgttgacaaggaggaacaatccgcatgagacaaatcacgatttctgggaacttaggtaaggatcccgaagtacgacaaacacaaaacggtatgcaagttgcaaactttaatttagcagttagacagactcgtccggatgatcaaggcaattatggtactgattggtttcgatgcgcggtttgggggaagcgcgctagcacggttgaacgcttctttcataaaggaaatcacgttacggtgacaggcacgtttgaagttgatgaatacaacggacaaacacagctaggggtgaacgtcactgattttgatttaccggatcgcgaaagcaaccagagtaaatcacagtcaaataatcaagcgccacaccagcaaccagagccttcagctggcggccagattgatattacggacaatgacttgccgttttaagttgaggtgatcgtgtggaactgctaccgactaagttaattgaaaaagatggcgagtggtatcaggttcagaagctaacccataagcctaaccttgaccatgttgagacggtaagtggttctgctgacgaatactacacgtactcggaattagctgacacacgtaaagctaggccacaacagcgacgcttgttcttcgcattgcttagtgacatctatacgtggtcaggcatgccgacagacttcttgaaaaacttgttttatttgcagtatgagtcatatacgtttggcaagcagattagcctgtcagacaccacagaatcgtctgtgagcgatgctaaccagttactcgacctagtcatcgacttcatgtttgagtggcatgtgccgttcaaggaaggctataagctattgccgcgtgagcaagaatattatctgtttcaatgttgccgccaccgagtttgcatgacctgcggtaatcgtgctgatatccatcatgtagacgttatcggagccggcttgaacagaacacacgttgaccacaccaaacggcacgttatggcattgtgtcgagtccatcacagcgagattgagcaaattggctccgtggcatttagtgcaaaataccacgtcccggtagatggcataaaactagataaagaaacgttaaaacgaattggcttgaaaggaaaatatgatgttaattaaattacagagtggtgattacatcaatagtgattatatagttcgtatttttggcgacgaaccatttattgaaatggctcacagagttgatgaaactggaaggcgatctttaccaatcactgatgttgacataaagctaatcacttatgcagtcaagaatgctcaggtaaacgatactaagcgatttatgaactggaaatacagcagtgactaatacaccgggtgggtggaatgcctactagtaaataagggaggattaaaagatggcacaaaggagaatgtttagtaatacgatcacggattctgatttgtttatggatatgcctaagtcagctcaactactatattttcatttgaatatgcatgctgatgatgatgggtttgtgggtaatacaaaatctattatgcggatgactggttcaagtgatgatgatttgaaaattttgttagccaagcagtaccttattccgtttgagaatggcgtcactgtgattaaagattggcatattcataattacatccgatcagatcgtaagcaccccacgaaatatactagtgagcttaaacaattagagctaaatgaagacgctagttatagtaaattaccttttggtagtcaagtgtcaaccaatggtcaaccaaatgacggacacttggtaggcaattgtcataccgaggttaggttaggtaaggataggttaggtaaggatagtaaaggtaagtatatagaaccaggtaatcccaagccaggaaaagccaaaccagcacgacacaaatatggacaataccagaatgtcttactgactgatgaacaattggcaaagcttaagtcagagtttccaaaagattggcaagatcgtattgagcgagtctctgggtatgttcaatctagtggtaaacactacaaagattacttggctaccattcgtaattgggctaagagagatcagcaaagtaaccaaagtaacaaagtagcgccacaaacacgagaggactggtttggctaatggaaaatgtaacgaagttattcaatcaagccacgattaagaaagtagtagcggctagaggaattgatacaactaagttgccaaccaaagaagaattggatcatcaaacaattgatcgggcaaatgcgggcgtaattgctaaccgaaaacggtattactatcgcatgtcagtctggtctggaggcgtgccgctacgatttagctttaatgattggcgaattgataagcagcctaatcaagctaaagctagagagcttggcaatcaagcatttaagttagctaggcaattagagactaaccagttcaacgtagcacttgcaggtggccctggtgttggcaaaacgtcattagcactggcaattatgtatcagttaatgggtgtaggccaaacagcgatgtttgtttcaacggctgagttgctacggctggtaaatgagaaatacgaagcaccggacgtacgtcaacggttactatacgttttaaaagacatgcaaaacgttgatgttctagttttagacgattttggtactgaaggcggtaagccaaccgaaaaaggattctacaagccagtgcacaaagatttgcagacgctgatgtatcaagtggcgaatgcgcgttgcgattttgatcataacgaagtcaaacatataaccatcattacgactaacaacacacgtaagcaattagaaagtatgtatgatggcaaaacaatcgatcgcttatataccaaggatactagctgccaattgctgtttgacaacatggaaggagtcagaagtgtatgagttgtgaattatgtcatggtagtaaagttgttcagcaaccgcttgaaagttatggcttcacgtttggaccatgcccaaattgtacgaatgagatacacgttcattacgaacaagagcttgaaaggaagttagcctatgacaagtaaaagaggtgagcgcatgactgaaannnnnnnnnngaggtgagcgcatgactgaaacacaggtgctagtaattaacgctgacagaccggacattgatcaaccgttagcaatcgggaccgaaccggaaatgtttaagctcgcgcaacataactataaatctggtgaatggccgttcccggttagactggttaagcctgggactaaggtacgcagtgatgcggcctacctagccagtatgaaacatgatccgaagcagggagaacgtgaagatattaaagccattcggcaagcacataagcatggcaaacatacgcttagagaactagctgatagtacggcaatggaattaaatcgggtaaaggatttagtccacaaatacagcctgccactgactaacgattactggcgtgctgagaagtatagtgatcgcctatcaaacactggcacgattatgcgagaagattgatgctccagagttttcgattaggcaggccagtatgtctaacgggatcgttaatggctactacattagccgggtgccgaaagcatgaacaaagtcgtgattaagggcgaactacctagcttaaatgagtacatcagggctgaacgggccaacagatacgccgcagctaacctaaagaagcggtacacggccttatgtagtgtatatgcgcgggctagtcgaaattctggagtcgaattcagctggccttgcaagcttaaatttacgtggtacacgaagaacaaccggaaagatgcggataatatcgcgtttgctaaaaagtttgtgctggacggctttatgaaggctgggcttttaggcaacgacaatcgaaagcacatcacaggattccaggacgaatttgccgttgataaacgaaatcctagagtagaaatagatgaaatcacggaggacgaagatgcctaaacacactaagaagcggtcaacgattaaacggaagcaccggcgaatgaaggaacacgccgaagcaaacaaagctaaagcacaggatagtaagcaattggccaaggaatatgagccatacaggattgataagcgggcgttcggggaggatttaaaatgagcactaaaaacaagattgggcttggcatgataatcttacttattttagtcacgatcattggtaacttcttagacggattttggcatggagttacttttatcagtgttgtggcatggattgtgatagcgctggaactatcgagttctaggagatgattggagatggcgacgatgattaagtttagagcgtgggacaaaaagacaaaagaatattttcgtatttctgagttgtggaactctgggacaaatccggagtgctttaattttgatgggtggacggataactttgggaataaaggaagactaaaagatattgtaattgagcagtttaccggcctgaaagacgtgaacggcaaggatatctatgaaggtgatattgtttcttttgggagtatgtggtgtgttggcgatgaatatgaccccagagaagaagaacacatcggcctcgtagaatatcgtcccgactatgcgagttatgtggttaattgcaacgggaaaatatatccgttagaggaattaactagttttgatggatattcagtacaaggtaacgtgcacgagaacccggagctgctggaggaaaggtaactgttaaatcatgaaatggacagacaacgaaaaacatcaaattgcacaactcgttactatgggactatcagattcagagattgccgaacgtatgggcaagacacgtgcagcagttaaacactaccgtcaacgccatgttactgatattaaaattgaagattccaaagaagttacaaccgaagccaatggcgtacaaacagccacgatcctcatgcgcttaaaacatgagcctgacaaatcaccacgcacaatgcttgcgctaactggctatgatcctgataaattcgatttaatcagttctcaatacaaagtatatgaacaacactcaaccgaagatggcacagttcctcaatacagtatcacggttaaagtccgccctaaggacgacataagcgtttcagaactaaccagtgtaattaacaatggggttaagcaaaagtacttaaagcgaacaccagctgtgttaaaacgcatgctggtggttccactttacgatttacattttgggatcaacagttatgataatatgaagccgtttttagaaaaaattcaagcgattatttattcgcactcgctacaaaaaatcgttatcgaacttggcggtgacctattacattctgattacctaagaactacaaaaaccgtcaagggcactcaactagatcatgttgatagtcgccaggcatgggaagacgctgcaaattttgtcaaaaacatcattgaaccggctatcaaaaattcggatgtcgccgaattacgagccattggtggcaaccacgacttcgatatgcagtgggcgttcgttgagatgatccgagcacgatacccacagttgtcagtatttaatccgggatcgtaccggcaagtgttcacatatggtcatgtgtcgatcatgatggctcacggtgacacagccaaagcgaaactgtcacaactgttcgccaacgaatatccggctgaatggtcaagtagcgtatggcgtgagacacattggggacattttcacacggaaacagtcaaagatgatggtgggacaattcagcgccaatttggaacgcctaagcctgctgatgggtatgagatcaaaaacggctacacaatgaatcagcacgttttggaagttctggaatatgacgtaaatggtttatctgcagaatacacattgaagggaaattaggcaatgaaacgaacgacgattagaaaagttgaagatattctacgtgactatcccaagattgacaagtatatcgagaaacgtgaacaggaattacgttatccaactgtccctcgtgatgacaatgttggaggtggcaaggcacaatacaagtatccggaaacgacactcaacacgattatcacgattgatgacgatcgacgcattaatgctttgaaacatcaacgggaagtgattgacgattgtctagatgatgtgggacatgatactgaagtaatcgtaaatgaactatattttaagaaacatcagcaatacacgattgatggactaattacaaaccacttaatcaacgttagtcatactaaggcgtttaaattaagaaatgagtttattatggaatgcgctaagggattgggattatatgaaatcgcgtattaattgcgtattttcgacccctataatcgtgctaaattggtagtatgccaaatgtgattgacgtgcatgaagtaatcctcaaaattacagactggtaatcgctgtgggctaattggtaagccacaatggtatgcaggttcgagtcctaccggcgatattgttatgcagcatggtcactcatgagggctaaaactgtgtaacatgtgcttgtggcggaataggtagacgcgcacaattcatccatgtgagagagtatatgtatgtggaatgcttaagaccattggcagcgtatattgggtggctccatgtagggtgcaaatccctaccaagcacattgaaagtaccgcggctttatgaatgcccttcataaaaccacgccctttcaaattgccaacaattgaatctccaaactagctctcgcttattggcgggagtttttgtatagttatggtagtttggaggtaggaacatggaaaaatcaaaagaattactctcaatgcttgaaaatcccgagtattttttgaatgcgcagagacaaacgctagagtctcgaatcgaggcaaaaaaattgactaaaagtgaaacaaaaaaagtgagaattgaaagcgcaaaatctgttggtaggaaagcctcaatggatctattgaaccaaagctggggggatatgattgttgatatcattggtgcacatgaagagattgagggaaagcttaatgagtctaaagaagctcttttacttggggagtatttaaataaatcagataaccaggaatatgcgctaaaacggcttattaatgtaattaccgatccgtatggcagcatcttatttaataaactgcttttaatattaaaagattatccggctgatggggacatgatggatatcttaagagatacattattaaacttgtccgatgtaaataactttaaaagtgtttttacaaagtacaaatttctaatctcactaattgataggataacccctcaggctatggtaattttacaggactacttgaaatggccaccttttagtatgtctatgataatcaataacgatcacgttgaaggggatatgagtaaggaatttacggatgcatattcacactctaaaggcattgatgatcctaatattgtatcgagaattcagtattcagtacaagaattacaaaaaaatgaatttgtttttggaagccagataagtaccggtcaagttattatgcaaccaagtgaggttgggatggacttgatcggattcataaatcatggttaaagaattttacaaacggcatgtataaaattaattataaggtaaggtgtggtggtatggcaaagctgattaacacaaaatatggctacgtcacgccacaggaagcggagatggatgcccacatagataaatggatgaagcgtcgtgctaaacacaaacggaggaagcaacatgccaaggacaagaagatgccgctatcctaactgccatgcgatggtcactttccctgaccactattgtcagcagcactatgagcatgaagctgagtacttggctagtcggcaacgttgggcacgtagcaatgacaaacactacacacacaagtacaacacggttacacgttatcgtaatgaagataagcgtcagcaatacaacttctatcggacaaggcaatggtcacatctaaggcaacaagtcctagagcgtgaccattacttatgtgcttactgtaaagcgcaaggcattatcacacctgctaaaacggttgatcacattgtgccgattgagtttgacgaagcattgaaagctaacgttgataacttagctgtaatctgcagtaagtgtcaccgactcaagacagactgggaacaagtaacttatggcactggtcaaggcaacgagctgcaaagcgtaacgccgatcaatgatgtatcgtcaatcgttgtgttaatgaataaggagtgaagatattgaaaccatgttattttaaatcaagtgcaatcattgatactgaaacagttgtcaaagctattaaacaatcagatttaaagtcagatgctaggacaacagacatgaataacaggtatgataagattcctgattacaaagtaattgaatcagtaatgcaacaggaactaaccgataagcaaattgcacatgttaagagtgaaattgaaacagctgttgtacagaataagcgtagggcttacatcaaccttgacggctttaatcatagtcaaaagataaagttggtacaggtgctaagcaacaaggactatcaaattgacgaaaattcaaactggcgctggtcattactcgtcaacttattggcgcctatcgttcgatttaagcaactttaaatttatgagtgtaattgttcgtgacgataattaaaacaaaccccgccccctcatgggcacctccctgagcacacacattggaaaaaaagtgtgacgggaacaatttttgaaaatttttaggtagggggggtcaaccaataatgaaaggaggcatagaaaatgaaaaaagcagataaagacgtcaacgatggtcaattatcacgtacaccgccagcttacttaggccggcaagctaaggtcgtttggcgtcgattagtgccctttttagaagacaataccccggttaagcgcattgatagcgggcttgtagagcaatatgcttcccaatatgagatttatcgcaacgcgtataaacatatccaggaaaacggtgaagtccaagcaatctataaaacattacaagatcagaccggtaaaaaaattggtcgagacttcgtgggctacaagcgtaatcccatgacacaaatttacgattcagcggttaaaaatctgactaaactaggcgctgaactaggcttgtcgccaaaatcgcgcagtgatttgttaaagctgaatttagatgatcacaaagacgatcgaagtattaatgatcgtatgaaagaatttctaggagactgataatgaagattgatttaacgcaaacacatgatgttattggagcttatcaatcattagactgctcagcgattcgccaacaatacactgatttgggcacaaagtatgcctttaatgtccttgatgagaaggtgattactggctatttgatcaagctagcggcttttcgccatatccgagacttgcaacgtcaaggcagcgttgaatttccctttacttattcggttaagaaagtagaccaagtgcttaaatttgcttccatctgtccaaacgttgatacaggcgaaccaaccaagcttatgccgtggcaagaattcattatggctatgctggttggctggcgtaatgatgatggtggcaagcgtttctcacgagcaattgtttcggttgcacgtggccaaggtaaaacttatctgatggcgattatcactacctatagttttttgattgagtcattgggactatctaaccaagattacttagtatcttctattaattataaacaaactagtaaaattctaggctacattaagtcaatgcttgctaagattgcaacgattgaaccatttaaaacactaattcaagatagtggcttagatactcggacgttgtcttcgcaagcggatcaagtcacaatgagcaagactaataacaagctacgagcaatcagtcacgaagccggtcagtacgatagttttcatttcacaacggctatatttgatgaaattggtgaaattaaaacacgacaaaagatttctaaaattgtgtcagggcaagttaaggtgcgtaataagcaatttattcaaatctcaacggcatatcctgatcccactgttccgtttcacgatgatgagcgtatgattcagcaagccatggaacaagattatttgcgcgatgctgatacatatttggggcttatttggtcgcaggacaatcttgatgaaacttataagcccgatatgtggattaaaagtaatcccttattagatttaccgagccaacgagaagtgttactgaacggcttgacagacaagcgtgattctgacgccttgtcgggcacactcaacgatttccaaaacaagaaccttaacttgtggctagaacagtcgaccgacagctttttgaaactgcctgacgttgagcgagctattataccatcatttagttttgatgaccggcaagtatacattggctttgactactcgatgtttagtgataacacggcgctggcgtttgtatttccttatcgtgatcataatgacaaaccaagatggtttatttatcagcacagctttattccctggcagaaagctggttcgattgaagctaaagaaaagcaagacggtattaattatcgggacttagctaaaaagggattttgcacaattagtagccatccacaaggactaatcaatgacgagcaggtctaccaatggttacttaactttgttgagcgacatagactggaagttgttttctttggttatgacgcatggggactaacaccaacaattaagcaattggacttaaactctggttggccattgcaagctattcggcagcggactagtgaattgaaggatccaactaagtttttgcagacgatgtttgttgaagggtcagttgaccgcttagatgatcgaattatggaaaaggcattactaaatgctgagatttatgaagacaaaattggtattcaagtcgataaagctaaggccacattgaagattgatgtggtagatgcgttaattgatgccctattccaagccatgtatcactttgaagactttgcagacgtaaacaaccctgataaacaggtcgaacgtatgaacgaaaagcaagttcttgaatggtttaataacccggaatcaggattgctaggagatgatattaatgatttttaaacaattttttgcgactatctggcgttactttgatgtactgtgctttattctaggcatgattgctggggtatatgcagcctttttatttgggcaggcacagggcgttctagcaatcgcggtagctttatttttagttggctggctttcagaagtcgtaacagctggccaaaaaggaggtgattaacaatgcctttttttgaaccaccaacggcaataaacaattcagttagtattcaaagcgtgccagtagaagacgataatatcgttaattttttgtcaccaactggcaataatgagtatgttagtgctaaagacgctttggaaaattcagatatttattcagcagttaaccaaatatctggagacttagccacgatacaattaatggccaatatgccacgagcgcaagggattctaaacaatcctagcacgacagctaatggccacacgttttggcagtctatgtattcacaactattattgggtggcgaatgtttcgcgtaccgttggcgtaatcccaatggcttagacctgcgctgggaatatttgcgacctagccaagtgcaaacctacttattagatgatggcagtggtttaacctatacggttacctttgacgagcctaatttgggcgttcttcaatatgtaccacagtctgacatgattcatattcgctgggctagtaccgatggcggtatgacgggtaacagtccattaaaagcattatcgagtgagttacaagtcaagagttcgtctaacagtttaacgttggctgcattagcacgttcaattagcgctcctggcgtcctatctattcagcacggtgggctgctaagtgagaagatgaaagccagccgctcacgtaacttcatgaaacaggtgaacaagtcaaacggtggcccggtagttattgatcaacttgaagattacaagccactagaaatgaaagcggatgttactaagctgttaagccaaacagattggacgagtaaacaaatcgctaaagtcttcggcattcctgatagctatttgaatggccaaggtgaccagcaaagtaatattgaccaaattaaaggcatgtacaccaacgcccttaatcgctatttacaggcgattttatctgagctggataataagcttaatgctaagataacggccaatatacggactgctgtagacccattgggagactcatttgcagccaccctatcagggctagctaaagatggcacgattgccaataatcaagcaacttggttattacagcagactggttattttccggatgaaatgcctgatgctaagaatccaacgacacaacaagttgtaattcaatcaggaaaaggaggtgataatgatgacaaagaaagtgatgattaaaggcgatattgttgatgatcaaacagccggtttctatcagttctttggaatgccagcagtatcaccttcgggcgttgctgacattttaaatgatgacgatgatgacggtgatgatgaagcacttgaagttgacattgcttccaatggtggtgatgtttttgcggctagtgagatttacactatgctaaagaattatgctggcaatgtaacagttaatattcaaggcttagccgctagtgcggcaagcgtggttgctatggctggcgatcatatcaacatttcaccaactgctcagattatgatccataaggcttggtcacaaccagctggtaatgctgacgatctggagcatgaagccagtattttaaatggcattgatcaatcgattgccagcgcttatgaagctaaaactggcatggatcaagctgacttgctacaactaatggcaaatgaaacatggttaaccgctagtgatgccgtcgataaaggttttgctgacgaaattatgtttgctaatgatcaacaattgcaaccggtgaacgctatttcacacattccacctaaatctgcagttaataaactgatgaatctcatttacaaggcggataaggataaagctaagccgtctaaagaagaaaatactactaatagtcaatctgctgaattacgaaacagcaaattggctattttatttggtaaaaatcaaaaggaggccaactaatggctaatattaacacgatgaatgatgcttggattgcccaagggcaaaaggtatcagacttgaacgacaagttaaacgcagctgtccttgatgacagctttgataaagagcaatttaaagcaatgaagcaagaccgcgacaacgcggttgcccggcgtgacgctttacatgaacaattggaagaagaacgcaaggcacaagaaattgccaacatggatgataaggacaagaccccacttgatgatgatgaaaaagacatcaaagccaagttcgttgagaatttcaaaggcatgattaagggcgacccgaaagttatgaacttggtaacttctgctactgacggcggtggtaatgcgattggtttgactatccctcaagatattcaaacagccattaacacattggttcgccagttcgactcattacaacagtatgttaatcgggaaactgttacaactcaaactgggtcacgagtttacgaaaagtggaccgatcttactccgttggccaatttagatgatgaaacggctactattggtgataatgatgatcccaagttatcgcttgtcaaatacacaatccatcggtatgctggcattaccactgccactaattcgttattaaaggatacggcggataacattttggcttggttatctcaatggattgctaagaaggttgttgttactcgcaatgctcaaatcattgcggcgatgaacaaagcacctaaaaagcctactttggccaagtttgatgacattattacgatgattaacactgctgttgaccctgccatcaagtccacgtcgttcttaatgacaaatacgtctggtttcaacgaactttccgaagttaaggatgctatgggtcgctatttattgcaaccagatccaacccaacctgatcagtatttaatccgtggcaagcggattgtagaggtagctgacaagtggttgcctgacgttacagctacggcaggaaaggctcatccactttactatggtgatttgtcgcaagcggtaactttgtttgaccgagaaagcacttccttattgactactaatattggcggtggtgcctttgaaaaagaccaaaccaagattcgcgtgattgatcgctttgatgtggaagccactgatacggaagcctttgttgcgggttcattcagtaaaattgctgatcaaccggccaactttgctgcttcaactcccggcaagtaattagccaactatgtcgccgacaaatacacaatacagtgacaatctgggcggctaagtaaggatgtgatttaagtggcagccgatttaaaaacattaaaatcatctttgcgaattgacgggaatgatgatgacgagttgctaaaaggatacttgtctgcagccactagctacattgaacaggccgtcggggatgaaaatggcgttccagggttctatgaaatggaaagcgtgaatgacttgtttgaaacggctgtttacgccttagctggttcatactggtattaccggacgtcaatcacttcaaacgctgttaatccagttgacttagttgttgattcaattattggccaattgcgaggcctgtataatcaaaagcaggatgaggtggacgacaatggcgattaataagttaactccagttgactttaaccaacgtatacagattggcactgttaaaactgttcaaaaccctattaatgggactagtaagcagacatttgttggccagtttagtttatactgcgcaccctatacacgatcaattgcatattcgtatcaacttacagctgaacaattagagcaagtagtggtcattattagacataatcctaaagtttatgaaggcattaaatgccaatataaaggtaaactttacgatgtcatcaatgacagcatagatgattctagtaattatctgtcttgcgattatttgacactcaaacaggttactaagggggcttagctatggcaaacgatgatatggccgaccaactagaaagctggcttaaagacgtccacaagctagtccccaacgaagctgaacaagagaagataaccaaagccggtgctaagaagttagctgataacttaaccgaagtcacgaaaaagaaacactattcaagtcataaagacgagaagtacggacacatggctgacaatataagctataactctaacgatatagacggcgaacatgacggtagttcaattgtgggctggactaacaaattccatgatatgaacgccagaagattaaacgatggtactaagtacattaaggctgaccacttcgttgaccagaacctagacgactcacaagatgatgtctttaacgccatgctagatgaatataagaagggggacgatgactagtgttattaccagtatcacaggtagccagcctagttaacaccctaaatttaacgtggctcgataaagtctaccttaacagcatacctaaagaagatttagacaacactgatttaacagtcatgctattacaagagactgattcaagtccggcctatcttgcaaacagcacgtttaaaggattagcaatgggtgttgagattcaaatcttttataaggttaacctagcagatgactttaacccattggaagctgaaatagctttaatgaaaaatcttaaagcgtccggctggttaattgtatctagtcagcaccacacaactgacccggataccaaccaagtaaccaaaacaatttatgtagctaaaaatgaaatgatttaaaggagagatatttaaatgtcaaaacacaacattgtcaaagcaacttttgctttacttgacagtaaaggtgacttaattaaagaccctgataaaggtctatctactgatggaatttatgttgctgaccatcaaggcgaagggttcagtcaaatcaacgtatccacccttgaagcggctggaactcccggctggggtaatggacaagtcaaacgaacagcctatggtaagtctatgcccacgctggctttaaccgccttagatttagacttcaagattaatcagatgctaaaggggttcacacaaagcgccaatacaggtgcatgggtacgtcaactacctaagcctcatgtggcaatgattgccgaatcacaatcattagatggggatatttcaatctacgaatgcttcaataatgttgaatttgttgaagaagggtctaacaactcaactgataccaacaatgaagcggcttactcaacagccttacatggtaccgtcttaacgccattgaagcctaccatcttcttagctgccaacaaggtacaacaaccttatatggtcgctaagtcgactgataaaggctttgacttaaccaagctatacgctgaagtatttggtggctatgtgttaagcccatcgagtgtagtgcctggtgtaggacttggtaaatagcaacaattaaaaagcttcccttaactgggtggctttttaatacatacaaatttaaataaaggggtacaaacaattatgaaaatcaatgctaaaaactattttaaaatcaacaagatggccaatgtaacaccaactaacaatatcattcgattagctaccaaggttcaaattagcatgctggagtcacaggacactgaaaaagagatcactgaactagacgcaatgaaaaatggcctggaattgcaggacgatatggccgattttgtgcaacgtgtaatgggctacactgatcagcagatggaaacgattaataacactatctcaattgaacggtttggcgaaggtgtcggctacttaattatgcgcttaaatggcatctcagacgctgacattaagctgtctgaacagaagcaacgtaaagccatcgaagacgctaagtcgtcaaaataaaccggcacaaacgcaacagcgagcttaaaaaggaagtcctaaagttgaaaaaccaacaggaagacttcaacctactagctcaacaattattaactgaggggttatcaccgaaagaatttgatgatagctccttctttaatatgatggctagtttaaacgctcgtaaaaaggaagaccgtgctgaactggttgacccgctagaggccattaaccaaacgtatggcttataagcgcttgtgccaaaaaggaggttaaaaaagaatggctaaaaaagtagtcggccgtgagatgaccagtagggttggcctagattcagcagaagctgttaaatcactcaagcagttaactgctgaggttaaagccaatactagtggctggaaggctcaggaagtcgcactaaactcggcagggaaataccaagaagccgcagcagctagggtagacgggttagctaagtcaatggagatgcaaaagtctaaaattgatgagttgaagaagcgtcaatctggtctaaataaagacactgaagatggtgcgcttaagtatactaaactgactgatgaaattaacaaggctaatcggtcatatgacagtatgggtggtcaactagaccgagctaaaaataggctacaatattacaattcaggcttggcagacctacaaaaaggctataaacagagtacggctttaagtaagtcttatgttgaacgcctagaagctgaaggcaaacaagaagatgctaataaggcccgtttaagtggtttaaaacaggcctattctaacattcaggcccaatacaagacccaatccgatgagctagaaaaaattaaaaaagctagtggtgacacttcagacgcttacaagctacagcagactcgtgttaatcagactgcaacagccatggctaaggctaagactagccaaaatgagctagttaaggcgatggaaaaagaaccacatggctttatgtcaggtgtacggtctaagttagattccgttgatgacaaggctaagaagacctctcatttatttggtaccatattaggtgcccatctagttgctaatggggttaccaacgctttatcgagtataacggcatcttttggcgaacttactagtgctgtaacagaatatgataacaagcaacgtacaatgacggccacatggactactttaactggttcaaacggaaaaggtaaacaaatggtcgacattggtaatgggttagcctcagcttttaatcaaaatatcaatgtggttgatgaacttaaccagtcattttaccatgtgtttgataatgcaccacggactaaagaattaactaagtccatcttaacgctgggtgatacgcttaacctaagtgatgagaatgttactagattaggcaccaacttcactcatatgctatcaagtggcaagatgcaacttggcgacttcaacatgattaacgaccaattaccaatgtacgctgaaaaaatgttggagtttgaaaagaagcaacagcataacagtaagttaaccatgtcaacgctgcgtgaccagatgagtgccggtaagattagcgctaaagacgccgaagaagttatgaactcacttggtggtaagtatgccaaggcttcagaaaacttgatgaagaccatacccggtatggaacgatcaatcaggactcaaatgccggcgttattagatgccgtttacaagccgattgcaaatatgaagtctccgttaatgggccagtttaccaagtggattggcgataagaatactaaagctgagtttaaagatgttggcaatgcactagccttgcagattaatgacataactaaagcgtttgctggtaaaaaatttaatgttggtgatagcctcaataagatgttgtctaatctagcaaaaggcattgataaagtcggtgctaacatcattgctcacaaaaaagagatcaagtcattctttggctcaatgaagaccgcttccaagacatcttttaacgtatttgtacagtcacttaaggacatcgagcctatactgaagattgttggtggatttgctgagaaacaccctaaagtatttgctggtttggcttctagtgcctttgttgcaagtaagggtatatctgcattaaaactagccttcagtggtttagacttggcaaagggcttaggtggcaagctcagccggattgtgttaaagccaaaggttgatggagctaaaggtgaacgagaactaaccaaatttgcaagctttgtcaagcgttcagggactggaatgggtcactggttaaagatggctgctagtgtaaccactgctaaagctaagagtggaattagtgctttatggacacacactaaatcagtcggtggcaagatcggcaaaggtctaaaatggactgctaagattgcttataaaggtgcatctaaagcttttagtgtcttagctggcggtatcaagttggttggtaagtcgtttttatcattgggcaggctattattaactaacccaatcggcctagttttaactgccgtggttgcgttaggcgtggcattctacgaggcttacaagcatattaagccgttccgtgaatgggttaacaagacatttaaatcagtggttaactttggcaagggtatcgctaaatggggttcaaatgtcggcaagtcggtaggcaaagcgctaggcaaagttggtaacaccatgggtaaatgggctaaaaccactaccggtttctttaaaaaacacaagaccgagatattaactactttgattaacccatttgcaggcttagctacatggttcttaaaggacactaaaactggtaagaatattcaaaagtggtctaaaggttttagcaaagacattcaaaaaatgggctttaagaaagcgatggacaaacaggtcaatgacgcttctaaggcgtttagcaagactaagttcggcaagtggtttaagaccgtttcagatagtttcaacacttggaagtctagctttaagaagagctggaacagccactggtcagacatgggtaaatcgctcaggaataactggaacggttccgttaagaacactaggaacttctttagcaccgttggcaataagtggaatggttttaagaacagctttagaaagggctggaacagtcattggaatgatatgactaggaacttgcatggtgcatggaacagttcttataagcataccagagacttcttttctagcatgggtaagaagtgggacggttggaagtctagctttagaaagagttggaacagtcactggaatgatatgcgttccaacttaaatcactattggaacaggtcatataagcatactagagacttctttagtagtatgggaaccaagtgggctggctggaaaaagagctggtcacatagttggaataaccactgggacaccatgcgggctaacttgcacagctattggaacaaagaccttagccatactaaagtgttcggacactcaatgggtgactggctatcagcctttaagaagacatttaatggcggctggtctggcttagtaaccggcgttgagaatatcttcaaaggcctttggaaggatttaaagaactttgctaaagatggcatgaacgatgttatcgaccttatcaatggtggtatcaatgcggttgatagtgtcatccatacgtttggtggtaaaaagaaaaccattggtgatttaagtcatgttaactttgccactggtactggtgtgcttagtgggtcacgtaatccgattaccaagcctactatggcaatgttaaatgatggtaatgacagtccgcaaactggcaacaaagaaatggtcatgctacctaatggcgattcaggcattgtgcaaggacgtaacactaagatgatgctacccgctggatcagaagtgctgagcgctagtgagacagccatgctaatggcaatgcaaggtgttaccaagtacgcgaaagggactggattctttggtgacattttaaacagtgtcactagtggtatttcgggtgtgactagctgggttggtaaaaaggtaggaagtttagagaaattctttaataccgctactaacatcattgctcacccaattaagtcgcttgaaaacctgtttagttggtcttctaagggcgtatcaggtgtcatgagtaacattggtcatggactattcaatggtgttgaaaaacaagctaagacatggtggtcaaccctatggggtggcgttagtgacagcctagacagtggtgcttctagttctagcctagttaatgcgatggagaagtacggtgctacaaacaagtacgtttggggtgctgaaggccctagtgcgtttgactgttccggcctggttgagtatgccctaaagaaacttggaattagcttcccacggactagtagtgagcagtacagggcgtctaagagtgtcagcaatcctaaaccgggtgacttggtattctttggcccaggtggtagcgaccacgttggggtatacaccggcaatggcgagttctatagtgctgaaaatgagcattctggtatgggtatcagtaaggtgcatggcggtggctatggtacgtttgctggttacggacgagttcccggtttatctgatagcactagctcggataaggcatctaagtctagtggactactcggcaccattaagaagcaagtaggtagtggcttctggaagttcatcagcaagttagccgatgagtttggtgatggtggtagtagtaaccccggcggctcaggtgttcaacgttggaagccagatgttatcaaagccttgaagaagaacggctttgaagccagtgctagtcaagtatcagcatggatgaaagtcattgcacgtgaatcaaacggtgacccatcagtggttaacaattgggacgctaacgctagaatgggcattccatctaaagggctggttcaaactatccagccgacatttgatgcttacaagtttcccggccataacaatccacttaatggttatgatgacttgctagctggtatccactatatgaaggctaaatatgggtcaggtcctagtgcgtttgctcgtgttagtggtcctgaaggctacgaaaacggtggcatcatcaacactaatcagttgattgaggtcgctgaacataataaacctgaaatggtgctaccattgaccaacaagagtcgggctaaccagttaattgcacaggctagtcaagtggtaaatggcaatactagcacgcagattgcgtctaatagcagtgaaagtagtgagaagcttgataaagtcatctcactattggcggctttattagctggtcaaggaaacgtacaagccgttatttctaacgattccatagttaatgcaaacaagaattacactaagaagatttcacaatactcacaaatgatggggtactaatatcccagtcaatcaaagggttgtccttaattgggcgacctttttacataattaaacttaaaaggaggttaaatcgtgaccttacaacgagacgattttgaatacgctaacttgaatagccgggacgatttacaggttgagatgggtaacgtggtattacctagtgcaccggccatggctgaacaggtgactgatataccagccatgtatggtaaccaatttaatggcacagactttaccagccggtcgattagcattccggtgtcaatctactgtgctgataatcaagacgcctttaatcaggtgatgcacaatttaagtggtctgctattaagcgatgaccccagtgataataacaaggagtatccattaatctttggctttgaacctaaggtgacatattggggacatattaccgcaattagtgacccagccccgattaacccgggtatgtatgacatgacactaaccattacctttgtgcagtctgatccccgggcgaccttgccacaggttgagaagcctttaaataatggcttaaatacgattactgttgatggcactgcacgaacagagccggttattcaggtcatccctaaacgagatttaaagtatattggctttagtttaaatggtggtcagtttggcttagggcctgagtcacctggagaccaagccactgcggttcaaccttatactaaagttgttgatgacccgctaggaactatggcaatgtggacaaatgatgccaatgcacttagcaatatgaaaactggtgaagcttacacgtatcaaggccacagcgagattaagactgaaactaatgtaatgcgaccaactgtaaatagcaatgggtatgactttggaccgatgcctacaactatggaagaccgctggtatgggccagcttatcggtatactggcatgacacaatcacttacggactggcgagtacgaacgggtattcatcaatttaggtacaatggtactcataatagtcgtgcaatgggacgtgttgaagtcttgctactagaccctaacggtaacactattggacgctttggtatgcgtgacatggcctatggtgctaaaccaatggctaggcttcaaatatgtgagcctggatcaacattagaatatggtgacagatatactgacttgtattatggttcagggccatcaggttcttttacgaataagcctgaccagaaaattcaaatcaaaactggcacgacaaccaaaactgtcactaaatatggtcgttccagaagaggaaaagtaactaaacaaaccattaaaaaaaccgttgatacctatacaaccgtggtcaataaggaggaggactccgcactggcaggtgcttggttagtgttggatattactaaacgaggacaagtattcacatggagtatcacccagtattcgactaaaacaggccgaccattcctagaccctcatattcacatgttagtacatggaacctatgttgatactcaaaataagtatcagacagccttaggtggaattgggtctgtctttctaaagcacccaattacagaagatattcataaagttgcctatcggaacccctttatgtcaatgactgaccttcaaatatggaaagtcaataaagttgatgccacaaagccaacttatattgctggtgccggtgaagaaattgtaatggattgtgaggcagatacagttactgtaaatggcaagctagtttcaccagtttggtcaaccgactttcctaagttgaaaccgggcgttaatggcttgtcgatgattggtgacctagatgacgctcaaatgaccctaaaatatctacctaggctactataacaacactttaaaggcttcccattaagggtggcctttttacataaataaaacaaggaggctaacagatggctttaaataaccagtatttaatcctagattctaatttaaagcggattggtaccctgactgttgatggtgccactaagttctctaacgacagcgtcaagattcaactagccgactcagacacgaccagcactagctatgacgatgatgccaatattggaactcaagataattttaacggcacgattaatctaaatgcccagtctaagaagttcgaccatcaaggctcattagacgtgcttcaaggccaaccggattcagataaagtagtggctggtaacaacctagcttattatgacgagccatcaggtcattggtatgtcatgcacatatacagcgtggaagaaagcaatacagccgctactaagcatgtcacaacggctaactttactaatctatgcttatacacactagcgcatcattacccagtggcaattacggctagtgctagttcgattcagacggcttttaatcagtgttttaatgccactggctggacgctagactatcagactactaatgtgatgactccatcgattaccattgatggtaaaacaaaagctagtacattagtacagacactcatccaagcttataacgttgagattgacccttatgttgagattaatagccaaggcaacatcacgaaaaaggtgtgtgtcattactgaccaacttaatgctgatgtggtctacaacgaggcggtatttggtaagaatatgactagcttaaagcgaacaacggtgtcaaacccaatcactaagcttatcccttatggtgctaacggcaacacaattgggctagtcaatgatggtaagtcttacattgttgatgatgaagccaatcgagcatataacccggactggcaagctggtttgtactatgagggggttgttacagctaactcaattgaagacccggctggaattaaggcctgggccgaagaaatgttgcaattgtataatcacccgcggacgtattatgaggttaatgtaacgtctaattttaacccgccattaggggccagtattcgttttaaagatgagttaatcaagccggcattaaatgccagtggccgagtcattcaacggacaattagtttcgctaacccttatggcaacacagtcggctttggtgaatatgtcacggtaccagttgcaacaccagcctggatgcaaggttatcaaagtgctattaatagcgccattgaaaaggcaaaggaggacgctagctcggttaaaccagtggctttaactcctgacggcaataatttcactgatactacccagactaagcggttaatcttacaggcttgggaaggtaacactaatatttcagcctatattgataacaaggggtttatttggcaccgttataatactgacggcacccttgatactagtttcaatcaaactggctatttagtacaagcagcatacaattccgttggcacactgcacgggactattgagaccagttacattcaagatgaaccagagattaagttacaaactagtgctattcgtaatttgggtagttttagcccagacgacagcacactaggaataactgaggcggcacaatatatgtgtcctttgagcaacggtcagtatataactagtcgggcaattaatcaaagtacaactggagataccatgtttgtcttacatgacactaattttaagccgattagtaagatgatcatttcacatggcgggcatggttcaagcttctcgattgaagaagtagatggggctgtttacatttggtctataactaagcctaatttaaacgttaacgaatatgcagttagtcgtataccctaccttgctaatgtaaccctaggaaatgatgatgatagaatcacacgtttttgcactgtcgatcgttatataagagtcagtgttgatttcaaacacgggtacgtactatgtggctacgtgaatggcaagcatgatgtgctacgactcgatgacgttaaacaaggtaattatgatgtgctatatagttttgatgttgccaactatgggtttgactggaaccgacaaacctaccaatcacaaggcattgactttccatatgtttactttcactcgggtggttacaacatgaaagatcctcgcatggtgtacgccgttaatgttgttcatggtgggcaagagttcgcctctaactacttactggatatgaatttagggttaaccgatgacgttatcgagcctgaaacatgcaacattatttatgaccagaataaccagccggagctattggctactttcaattgtaaatatcaaggtaattatttagaacgcgtctttgtaataccaattaaagaacgtttgccaatgattaagaaaggaggtgaattaaatggctgaatctaacgcaacacaggtcattctaacagatgatggtattaagattatcaaggctcaaaatacggctgagaatgccactagtgggatcaccaatttaaatgaccccaacttaatgagtgtcattgaaaagcaggcacaggcctcacagtatgctggattaactagtcagtataatgtgattttaaagcgagctaaagatgccagcatcagtacgactgctttaaccacggcctatgataaactgaacacctttatggcggccatcttaacggataccactaaggccagtgattttgaccgggacacttataagagtctcacagacgcttacaattctgctctaagcactgtacagaacgccttaagcaacagttataacactgatattagcaacatgaagtctagtgtatcggtagctagtcaagctgcttctagtgctgtcatagtagcatcacaagcaactgcaacgggaaatggtgctagtcaggctgcatcacaagcccttggggcagctaacgaagctaaaagcgccggtgagaatgctaagagtgctgctgctgaggcacaaaccgctggagaagacgctaaaaagcaggttaaggatacccaaaataaaatagtatattatgcttcaatctcagatgaaaaagacattgctatacccggcaaatatattatagttaacaccgacacctatattaaagacggtacaattaaaactgcacatataggtgacgctgcaataactaaggctaagattgataaactagctgttggtgaggcacaaattgaagatgctgctatcactcgtgctaaggttggcaaaatggctgttggtactgctgagattgaagatgcatctatcacagatgctaaagtaggcgacattagtgctaaccatttaaaagttggtacgattgactttaataagattactggtaaaaatattaacgcatcaaacatcactactggaacaatgagcactgaccggctagatgttaataagctatcagcattaagtgccaatttaggcgatgttactgctggttcacttaaaggtgtcgacattgtggctaacacgtttagcacgcctaatggctcattcacaaccgatgcaagtggcacgataaaggctaagaacatgacgcttattggtggcacgttaacctcaccaacaatcaatactagcacgattaatggttcaactatcaatgggacaacgttcaatgccggcgacagtattagtaattctaataatacgagtaatttctatccattcaccattgaacctactggtaaagcttccacgacactttttaattcagtggacgctctaagaacagagatgagtggtggcggactaagaaccatgtatcgcgccataaactcttccggaagtcaatatgaagcttatgatggcaattttagtggcgatatgatttctttgaactctggctttactaatggcaaggatatgtcattctcacaatccgtttctggaagccaattaactggtcaagttctgatcagtccgttgaatgggctgacgctacacggagatactcaacaaatcacctttaatggtacttctgctgatgttacaccgaagggcatcattattacgccctacggcaatatcaaccctaatggcacacaaaatatttggtatgtcggcaataatatgaatatgaagacagccagctttggcattgacggttcgggtgctaataatattcagttcaatcgttctttagatattggcaacttcaacataaatacctatcacacgattaccagttccgacaacggcccgatccatttcaatcgtgctaatggcaaacccgtcgacatctacgctagtaccgttcactatgatagtctagttaaatcgtccctattaagtgttaagcgtgacgtgcaaaaggctgatacatcctattgggcgcagctagttaactcaattgacttggcaacataccaatacaaaaccgacgataataccagtcatttgcgattatctagcattgttgacgacgttaatgtaacaaagcagtggcaattgccagacgtgtttatcagccgtgatgaagacggtaagctgtgtggggtagatgacagtgtacttttaaacgccaccctagccacggtacaggaacagcaaaagcagattgatcaattaaacgggcacaatatggaactagaggctagattaaacaaattggaggccaaattaaatggatagcattttaatcacgaattataagccggattacacgaataacattatgacaatcagtattcagattaacacgctgggtattagctcacaggtaagtattaccatggacgaatttaacactgccattgctggaggtgctgggggcactgatagggttaaattgaaggtgttgaatacgctgattgacagtctgaccgctttaaaaccagttaccacaactatgacaacgaccaatactaaggaggcttaaattatgaatgttgatgcacaggctttaattaacaagctaacaagtaactatgcccaagcgattgcccttaaagaccagcaattagcgatggcacaagttcaaattgaccagcttaatgccaagttggctgaaaaggaggcgcataaagatggcaaaaacgcttagttttactgatatgtccccacggacggttaaaattggtgatacgactaccagtttcacgttaatttgtggcaatgataatggggccactgatttaactaatgccacttcaattactgttaaattgggcaatgctagtggctaccttaaatcggccacagttgacccagctagtctaacggacccaacggctggtaaaattaccgttgcttttaatgctgacttgatgactagtttgccagctggtagctatgccattgaagtgtgggtggttgatagtaccgggacgtcaatctaccctagtgatgggtcaaccggttttactattaccaataacattcaaagtgccaatggtagcacgattacgaccattacttttgatgactttgtgaaagcaatgaataaagccgcaagcacaattgctaaaggtgacaaaggtgatacaggaagcgttgataatgctggcttgaccacagcaccagcttttgttgagcttaaagcgcaggttgataatagtgccgtgggtatcaacctattaacaggtaccagcaatcaggtggttcaagccaacaattggaatatgcaagttgctgacatcaaatatgataaaagtcttggcaaggctctatgtgcgtctgttatgattaacaacgctgactacgcaagtaatttattacgagggtcagcaagcattaggatggacacttttgacaaaagtggaaaaaccttagcaacagtttggggtgtaagtgttaactataatgccaatggtctaagtcagtgttccataaacattgatgataataccgcagaggtcaaagcgcatatcttgacgaataacatgaatgataacgcattttattcctgcttaaaaattgagcgaggcaccaaagctacaccatggtgccctaatccaacagaaattttgacacaatcagattacgcaaaaataaaagcggctattgtagcgctagggggggctttgtcatgagttttgatttaagcgaatttttaacagaaggtttaattaacagtgttaacaatgggttaattccatcagatttagtaactgtatatgctggcaattatctagtgaaatcactaattacccaaactcaggttactcaagtatcagaggcaattacagcctacaaagctgcacaagcagaagctactgctaaggattcaaaagaagctcaagaagttgctacgcgagccgattcatccttagctgcacagacagaagctaccatagaccatagcagcgcacactaagaggtagacaattgaataataacaaattaaaggcactcatcttaatggcgagcgccatttttatggtctttttgatggccaatgttaccagtcaggcttcaactagccgtgaccaaggggttgattggtctaagtttcaaggcaatagtggtgtatttggctacaacactgataagtttgtattctcacaggcgggtggcttctatggtgggactaatatccctcagaccacatatgctagccaagttaagtcagctcaacaggctggtaaacgggtgcacacctatttgtgggacggggttgggggcaatatgaccaatgccaaggcgatgatggcctattacttgccacgagttaagacgcccaagggtagtattgtagcgctagactatgaggacggggcaagtaatagcgtgacagccaacactaatgccgttctagcccagatggccctcattaaagcggctggctataccccggtattatactccggcaaagcctatctaaatgctcatgttaatgtgagcgccattgtacgtgcctatggtagctgtctgtggttagctgaatatccggattatctggttagaactatccctgattataactggttcccaagtatggacggcgtggctatcttccaattcacgagcatgtataaatcaggcggattagacggcaatgttgatttaactggcattaccaagtcaggctatacgactgctagcaaggctaaagcacaggccaatgttaagaaggctcaaaaggctaagaaggccacctttaaggtcattaaatacaaccagcgaggggtgttctatcctaatcaggcactagctgttcgctacacggatagtgacaaagttagtcaagtggctacctattacaagagtgagagtgtaacttataacgcggttattattgaacacgattatgtatgggcacgttacacccgttcaaatggcctatacggattcattaagctaggcgtcaccaatgggccagcctacgggaagcgagttactggtcagccggttagtcatacgtactacacagtcaagtctggcgacagctggtgggcgatcgcacaacgcaacggcctgagcatgactacactagctagccagaatggcaagtcaatttacaccactatctatcctgaccagcgattggtggtgagataatggcacaatatgatgacacaactaagttattaatggatattcaaaaggatgtggccgccaccaaaacgaaagttgagaacatcgaagaaaagctgaatcaagttgacgatattggcgacaaagcggacaaggccctagccaagtcaatcgaagccagccatcaaattgaccgcgtgacacagattcaaaattggctaatcggtgtcttggttagtggcgtgctcgtcacgttagttatttacatcgcagaaaagttcctttaggaggtaaaacatgattaaaaaaattagcttcaagaatgtcgatggtagtttgaatggtaagttgattgctgggattatttcgttattaattgtgttaatccaacaagtctttgccatgtttggcattaaatttactggtgactggacgagtattgtggccgttgttaacacggttctaactatccttggtatgctgggcgttattactgacgttcaaacagtgacaacaccaacagttaaaagtgacgaggaaagtcaggttgaaacgaccgctaatgcggttgctgacgaagcgcaaacaccaacgtccacagtcgctgtagtgaatagttctgcatcatctgacactgaaatggcgtcagaatccgcctcacaagcagcaaaatagtgctataacttgatatagagtttaattaattgtggagcttgatcactctgcaacttttcccctgcgtttcggcgtgggggattttttatgtattacccgcctaggaattttggtgcacatttggtgcacgccgtgaaacaaaacgttgctatgtcagtacctaaccaccgtatactactccgggtggggtcagttgaatattagaaagcaccgtttcagggcagcgttttagtgacgttaccttggaacggtgctttgggtttaagtagccacaaatgatatgaaatcgaaatgaatactgtattagtctaaacgcccgctaccagtccaaatgactagtagcgggcgttgcgattaacgaatgacgatgacgttgcaaggggcgtgatccacgacgtagctggtcgttgaaccaacggctacgcgatggggcgagttggtaccagtggcgccgagcacgatcaagtcaatttcgggatgttgcttggcatagtcctcaatggtgtgttttggaatcccgtagctgatttcagtttttaaattcggtgcggacgtggtggcgacgaattgttgtcgctgccgcatggcatcctttgcgtgagcggcttccgcgtctagtaattcagatagaaccgggtcgagtgcgggggtgtggtaggcgctgtcatccaccacgtagagcgcagtcaggtttgcttggtgccgctgggcaatgttgaccgcttcggtaaaagcggcttgtgcagcatcggaactgtcaacgggtactaaaatatttgtgtaacggcttggcattataaccacctccagttatctttacgataattataatggattagtgtcgggcaataaaattaaacgcacctagtgggcaaggtcgatgaactagcgtatattatagacagtaaatttcttttgggggttaggtatgttaaagcatgtacagaacagcctattgacctttgaacgggtcgttgagcggcaacgttattggcgcgccttacgtgatacgttaacgctgctttttccaatcgcattagttggggcgtacgttagttttatgaaccaggcaatctttcagcgcaatggttttttgaatcatatttattatctcagtcactggctgccgggttttaaatatttggcagcttacacgacgatgcttaatctgagtatcaacggcattcttgccgtgattgcggctttttcagccgctaattttgtcgcgcggagtgctcagcgtgataatttgttagcgggattgacggcggcaattagttttatcatgcttaatatcaattataatttttttagtacccagggtcagcctgctggcagtcggtttttagaagataatttgggaactcagggcatcttcctcgcactattggtgggcctgttgactggttggttgttcagtcatttgacacggtatccacacatccaccaggagatcgagacccagacgcacttgctagcgcgggcacacgcgaactggttaccgatagtcgctgctctgctggtgttcagtgccatcgggtatggtattagttttgtcagtaaagggggattaaacggcctgttttacgcggtcttcaccttaccattcagtaatccgggggcgtcgctactagcgataattggcgtggcatcactcagcaatttatactggttaattgggattatcggtccggttgactttagtggtaacagtactacgagtacggttcaaaatttggaatatgcgttgcaacacggttcggcgtggggcgcgccaaatccagtaacgctccatacgttatttgatgcgtttgcgaacgtaggtggtcccggaatgacgttagcgttattgattgcaattttgtggcgttcacgtaaccgtaattatcgaacagtggccaagaccagtgccttgccagtactgtttaatatcaaccaaccgttgctcgtcggcttaccgattgcttatagtccgattttagcgattccgtttctgttagcgccactggctagcatggtcatcacgtggtgcgcgttgaagcttcaatggataccgccggtcgtttatccggttggtagaacgatgccaggcttcttgaccggttggctgggaactggtggcgactggcgggccttcatcgttagtctgatcaatatagcggtggccacagcaatctacttgccatttgtcttactggcaaaccaggttgaggaggaggcgaaggcggatgcttaaacgatattggtggcggtggcttcttggaatcggtttgttagtcgggatctgttggccggcctacacgtggactcaagtgaatatcaagacgctgaaaaacactggtcggacgcggatggcaccagttattatggtccccggatcgagtgcgtcacagaaccggtttgatagtttgattaccgagttggggaaggaaacgccgaaaaaacacagtgtattgaagctgacagttcagacggatgggacaattaagtatagtggttcgattgctgctaatgataatgagccgttcatcgtgattggcttcgcgaataatcgtgatggtaaagctaatattgataagcaagctgtctggttgaatacggcattcaaggcgttggtcaaaacgtatcactttaatcacttttatgcgctaggtcattccaatggtggcctcatttggaccctctttttagagcgctatctaaaggaaagtccgaaggttcatattgaccggttaatgacgattgcctcgccgtacaatatggaatcgacaagtacgaccgccaagacgagcatgttcaaggaactttaccgttatcggactggtttgccggaatcgttaaccgtttactcgattgcggggacggaaaactataccagtgatgggacggtgccgtataacagcgttaactacggtaagtacatctttcaagatcaggtcaagcattttacggagattactgtaacgggggcgaatacggcgcactccgatctaccacagaataagcaaatcgtcagcctgattcgacagtatttattggctgaaacgatgcctgacaaggttcgtcaaaaaaacgcacaacgggtacaaaattagttacgttgtgtggcagtgctactgctgttaagacaacactggtgaacgatctggttaagaaagttatacatgcagtgaatagaacaacaaaaacgattagcgtctcgtaaccgggacgctaatcgttttttagttagatttgcaataaattaatgatgatgcctagcgttgtgtgagcgggctgaccgtttcgagtagtggtgcttcgacggcttcgcccggtgcttgactcgcattgtgacacgggttccccgaactcgcaaggcttgtgcattggttgccggcagggtcagtaaaccgccacagacggccaggatgacgagcactggtaatcctcggtggatcgacatgatagaacgcccccttaactaaagtccttatttagtgtataagtaattcgagtcagcgtcaacctaaggtccgttactgactttacaaaacgttaacggcatattaacggattattcacaaaaagccgtcaaatttgattgtattttgccaagttttcctttatggtgggagtaatatataaaagggagtttggctaaatgaatattgaaatcttaaactcagcaatccaagacttacatttccaaattgtttatgatcgttctgaagacgatgacaatcctggtcagggtcaattcagctatacgaccgccaatccagatgttaagaagacgtttggcgatgacgttgtgcaggcccaattacaagtgacctataaagaagaaatgttcgacttatccgcgaccgtttttgcgattgtacgcctaagtggtgagatggtgggaattattgaacgtcaatctgacaacaaatcaattgaagacgacgaacaagaaatgttgaacaatttgaatggtgccatcattccagcgttgtctgccaaagtccgggcctatgcagcattattgtcaactgaagctagcaactttgccatcatgccagctgactttgatgatagccagcccaatgatgctgaataagcgtaatccaagagcttgtcaaactggcaagctttttttgatgacttaaggaatgagttctagcgttgtgtaaccgttaacaaaggtgctataataatgatggtcagagttgactaggcaactgcggttgcaatgacgaggtcagaaggtctgattggtgacttcagcaattattactttgatccaggcttatcggaatggttcaaagcgggggtgaccgcaagtcggtcagcacacataggggcagtgaatattgacacatagtttgagccaagctggtaagtatcgtggtggccaagttacgctgtaatttggccgctatttttatcttattttcagccgaacactgcgacaaaaaatgaaaactgtcgtgatgaaatcactgtaaattgtcacatgaaagcgtatactgacggtgagaggggtgagtgttatgtttaaaccaatggcatctgtttttacgaaccatcaaattgcgggtcattatcgggccattgagcgggcgcaaaagtgcgtggttccatttcattttgagattcagggacaggagtatccaaagccaaaaccagaacgtaactggttacggcgcttatcggggacgtcgagcgagaagtacgcaatggtcgaactgaccccgacaaaggtcgttttgtggtcaccagaaggacgcaatctgggtgaaatgccactgagtgcggtgcggcgaattcagatcggtgcgattcggtgtcacgtaacggaaggactcgacccacgccacgcatttcgggcgacgatctttgtgctgactgatagcggtaattattattttgctaattctgatatggaagttttaccggcgatttgtaagttcgcccatgaacatcaagtgccggtagaagacccactgcggttgattccgcttttaaaggtcggttggcgggtcgcggccgtgacgttacatgagacctatgcgcaactggttgcgcacacgggttacccggctgataaggtttaacttaattttatgattaataataatgaaaaacggactgtcgataacgacaatccgttttttactgcggttaaatgtagttggcttaaactaagccttgcgctaacatggcgtcagcaacttttgtgaagccagcaatgttagcaccactcaggtaatcaccgctaacgtggtattcgtcggcagcggcaacggagtgtgcaaagatatcttgcatgatttgcttgaggcgattatcgacttcttcaaaagtccagctcaaacgcatactattttggctcatttcaagggcggaaacggcaacgccaccagcattggcagctttggccggaccatatagcaagctggaagcttggtatgccgcaatggcttctggactgctaggcatgttagccccttcggcaacgaccttggcaccattggcaatcaagttcttggcttgatcaccgctgatttcgttttgggtggcgcaaggtaacgcgatatcataagctacttgggcgtcccagacggaaccttcgtaatagctggcactggctacacggtcggcatagtctttgatgcgaccacgttcaacttccttgatctgcttcacgatcttgaagtcgataccgttttcgtcaataacgtaaccgtttgagtcggagcaggtaatcaccttgccaccgagtgcttcaaccttttgaatcgcgtagatggcgacattaccagcaccagaaatggcaacgcgttgaccagggaaggaaagttggttggccttgagcatttcgttggtatagtaggcgagaccataaccggtagcttcagtccgggctaacgaaccgccatagttcaaacctttaccggtgagtacgccgcggtcagcgccccggagtcgcttgtattggccgtataaaaagccaatttcgcggccaccaacaccgatatcaccagcaggaacgtcggtatcgagaccaatgtacttgctcagttcggtcatgaaactctgacagaagcgcataatttcgttgtctgatttgcccttagggtcgaaatcagagccccctttaccaccgccgattggcaggccggtcagggcatttttgaagatctgttcaaagcccaagaatttgacgatactcagattaacggatgggtgtaaccgtaagccgcccttgtatggaccgattgctgagttaaattgtactcggaacccacggttgactcgtgcatgactagcatcgtcgagccaaggaacccggaattgaataatccgttctggttcggtcaaacgttccaaaatattggcttcgatatattctggatgttgttcgaggactggcgtgatcgttttgaagacgtcgttgatggcctctaaaaattcggtttggttcggatcacggtgttcaatgacttggtaaacgtgttggacataatcagttgcttgactcaatatgatcatccttccttgaataagttaactataatcttcattttaatggtcacgttcggaaattgcacgagttaaattaactaaattttgatgaatttttagtgattgtggtaaaaccgtgctgttgatagcgcttgcgatttggttcggcggactaacaataattcgcattttaatgcaaagtcagaagtgagggcgtatgcttgtgacaattaaatagtagtcaagtcagatttgacgggcgactcatcaggaacaggggggatcatgatgaacaaacggcgttggttattaagtttattgccaatcttactggggttgattggcgtgggtgtgtggggatcacagcaattaggtcaaggagcacagcaagtgacaccaaagacaattaaagtacagcaggcagcgtcaaaaatcaaatccgcgacgaaaaagcaaacgacgactaagcctaaagtgaagcccggccagcttactgaggcccaggcaatcaagcaaatcgatcagttgatcaaaagtcatcatattatggggacactattactgaccacgaacggtccggcgggggtccgggtccggacgtatggttatgcggatgatgccaatcaagtccgcaatactgcgacggaggcttacccattagcatcattacaaaaagctgtgactggcgtgatggttcaaaaactgatcaatcagggtaagttgagtctgacgacgaagctgagtcacttttatccggaaattccgtacgccaaccagattacgatgcgtgaactattagaccatcgttccggtattcggatgactgagatcacaccaaagacgattttgccaacggagacggcgcggctgaactttacactgcaacatttacggtcgacgaataatcatgcttatgcctattccaacgcgaactttaccttattagcaggggtcattcgcaaagtgacgcataaatcctatcaggcggctttgactaatgacatcattcggccattgggattaaaacatacctatgaatataacgatattccgggtaatgtgatcaacccgacttcgtatcgcttggctaatgggtttggtcagagtggcatcatttctaagccgttacaatctagtgaattaggctgtggtagtctatatatgagtgtgggggattattataaatttatgtatgggcttcagagcggccagctagttggcgaagccggtttaaagtcacttgcggataattttcaaattaaatattcggcaggcgtttattaccaggcaggccagttgattcgagtgggtggcaatgacaataattttcatagctactatatggggtcacgaaatgccaaagtcgccttagtcttatttgaaaatcagggtgtttttggtggtgacaaccaggtagcgtataagattcgtgatattttattgaagacggtacctttttagaaacggtacgggctaaacatcatcttaattgcaggagaacgtgtgcctgcaatcaaggtggtgtttttgcttacccgtccgtttggctgaatccttgaaaataactaaacttttactcgaaatgatggcgccacgacgtaactaacgctatgatgagattagaaactaaatgatgcaggtgaaagttaatgacaaaaccaattaaggtaatgacgattttcggcacgcggccagaagcaattaagatggcgcccatcgtgttgcagttgcagcaacagccacaatttgaaccggtaacggtggtgacggctcaacaccgcgagatgttagaccaggtgctcacgatttttcacattacgccggactatgatttgaatatcatgaaacctaatcagacgttagctggtatcaccagccgggtactgacgaagctagatgcaattatggatacagtcaagcctgatatcgtgctggtgcatggcgatacaaccacgacgtttgcagctagtgtgagtgctttctatcatcaaatcccagtcggacacgtggaagcagggttgcggacatggcagaagtactcgccatatcctgaagagatgaatcggcagctgaccgacgtgctggccgacatgtactttgcaccgaccgaattaagtcggcagaatctattgaaggaaaaccatccggatacggccatcacggtaacgggcaatacggccatcgatgccctaaaacagacggtttcgatggactatcaacacgctgcgcttgatttgattcagcctgggcaccggatgatcttactcacgatgcatcggcgtgagaatcagggcgccccgatggaagcggtctttgtcgccatcaaacgagtggttgctcagcatcccgatgtcgaagtggtctacccagtacacttgagtccggcagtgcagacagtcgctaaacgtatcctcggccataccgatcgcattcacctcattgacccgctcgacgtgcttgatttccacaacatggcggcgcgcagttacttcattatgacggattcgggtggggtgcaggaagaagccccgtcactgaataaaccggtgctcgtattgcgtgatactactgaacgaccggaaggggtcaccgcggggacgttacgattagtcggcactgatggtcagcaggttgcggcagcgatgaccagcctgttagatgattccgcagtgtaccaacggatggcagacgctaaaaatccttatggcgatggtcatgctgcggaatacatcttacaagcgattatgaaaaaaattggtacacattaaaattatttacatttttgtataaacagtgtaatattaagcactgacatagtgataaaaattttcacttctcctgtaaagatgtgaaattagtgaagtagccggagatggatgccgcgggggtatcaataccggttatttttttgcgttaaaatctagatggcccggtactactgagtgtctaggcagctacttgattttgtcaaagtggctgacggctgggatataagcggattttactcatcagtggtcaggtattgccatcaattgatctgattggaccgattagtctattcgctgaaagcactaatcctagtataaaaggtgtttcccgcggcattccattgtataattgtaaatactataagtgagcgttgaggataaatgaatgaatttaaaagcccgttaccctaaaattgcgaaaagcctggaaattattattcggcggtatggacaagccaatgtcagcaataatgcgattgtgctggcctactacgcgttaatgtcgattgccccgattatcttgattgccggaaacctcattgcccggttcgatttgaagtctggacagattttagcgtacgctcaggaagtcattcctagtaacgtctaccagacgtttaagccgattttagtttcattcctgtctagtggcagcagtagtagtttgtcaattgggattttggtgacagtctggtcggcgtctaaaattattgctgcgattcgtaggagtctaaatgaggcgtacggggtcacggatgcccagaatgccatcttgacacgggttattgccttcttcttaacgctgggactattactcttaatcgtagggctggcgattttctttacgttgagtcagttgattctagatgtgatcttgaatttaacaaatctcacgcgtgcaatcattccgaattggattaatcagttgttggaaaacaaaaacttgattacctttgttgggatgttcgtcgtcgccatgttgttgtattactttgtaccgaatgctaaggtgaaattgcgctacatttggacgggggcgttagtcacgacgattggctggatcgtgatttcacaagggttccgggtgtacattgaattatttgctaaacggattacgacttaccaaacgattgggagtttaattgtactgatgttctggttgaacttttccgggattctcttgatgtttggtggcgtcgtcaatgcgtcggtgcaggaatggtttgagcataagattgagccaaagtctccacggatgattcgtcgcattcggcgacaattcttcaaacgcaaaaaaacgactaaaaaagaataatcagaaccttttaattgaatccgaacgtttaatcctgtaaaatcaaaactttttgcgatttacatattaaacgattcggattttgtgtataatggtgttcgtgtgaaaaaagtgccggtgctttctgaaagtaagtggcgtctatttcaaaataaacaggcgtaacaacgccacaggaggagaaagatagtgattcatcagcttttggcagagttcatgggaaccgccttgatgattatttttggtgtcggtgtacattgtagtgaggttttaaaggggaccaagtatcgtggttccggccatatcttcgcaattacaacatggggttttgggattacaattgccctcttcattttcggcaatgtctgcattaacccggccatggtattagcccaatgtattttagggaatctttcatggtcattgttcatcccgtattcagttgcagaagttttgggtggggtcgttggtgccgtgatcgtctggatcatgtacgcggaccattttgccgcttctgctgatgagatttccccaattacgattcggaacttattctcaaccgcacccgctgtgcggaacttaccacggaacttcttcgtcgaattcttcgatacatttatttttatttctgggattttagctatttctgaagtgaagacgccgggaatcgtgccgattggtgttgggctcttagtctgggccattgggatggggctaggtggcccaaccggattcgccatgaaccttgcacgggacatgggcccacggatcgcccacgccattttaccaattaagaacaaggctgacagcgactggcaatacgggatcattgttcctgggattgcacctttcgttggggctgcttgtgcagcgttgtttatgcatggattctttgggattgggtagataatatagtaagtttgtattcctgaaaatcaattaaagagcaattgaaagtgtaatatttctttcgattgttcttttatattgtctgaagaataaagcaaaagttatatttatggtagattgtaannnnnnnnnngataatggctaaggcctcgcgcgtgttccgcgcaaaccgatccaacttagtgacaatcaaagtatcgcctgtttttagaacgcgcaacagtttttgaaactccggtcgttcagtagttgtgccggtaaacttttcctgaaagattttttctgctcctgccaattttagtaactcaatttgatttgctaatttttgatcagtggtactgacccgcgcatagccatatttcatctttttatctccttacttatgtcattaagtaatgacacggttctaaccctttaattatacagcatcaaaaaagaggccacaactgttaagttgtgaccctatttttgatgatctatgcattttttgtggaatatgaggataccaataaaaattagagaacgtcttgctgctcatatttctacaaaaattggacgttccgccatgttcatcacctattttcatactaataaaacaatgtctggtcttcttatttagacagttttaataaacatctataaatccaagtatagtatgctatcaaaaacagccattaaggcataccctattggcctaaaaataaaaaatcaacttatttggtagattgtaaaattacccgcgtttacaatctaagtgcaacacataattaaatagaccaaaaaggccatgatgacctattcttataagcaaccaagcacataagaaaggcacatcatgaccaacatcaagcgtaccatctctaaggcttaccaacaactatcaaattttgatcgcgttcgcattgaaactctgctcaatcagggattctcccaagcacggattgcccgcgaactcaaccgctctcgtagtactatttcgcgtgagatcactcgtggctccgttctacagcgaattcccgggcataaggtagcgttgatttactttgctgatacggcagcttatctgcacgctcagcggcgggatcggtgtcgccccaagacgatgcttgagaagaaccccgagttttacgccgcctgatttaatgctttccatggttcaaataagttattaatcacgattaatgatttatttgagctgtggaaggtaaacgcggttctgaatgtctcttaaaacctgtctcaaatattgacttcaatccatgtttgccattggaaatctaggaagcaaattaatcagctatcaaaaggtaaatgaaaaatcttgaattgcagtcaataggtgagatcgcttcttggacttcaattgtaaatcaaccaatgcgatgttatatttgatgatagattgtatttaatagcgttagttaaaacgtgttttaatcttgttaattttggagagtgaatgatggatcaaacagtaaattttgtcctttttatccggcttgttcgtaaatactggcttacaatcgttagttttacagtggcgggattaatagttgccgcagggttgaccttctttgtaattacacctaagtaccaatcaagtgtccagattttggttaaccgtaaagatactaatgccgctactgagtatgctgggcagcaggctgatattcagatggttacgacctacaaggaattaattgctggacaagtggttttaaaaccagctaagcaacaattaagcaaacgttatggcattgagcgctcactaagcacactaaaaagtgaggttagtgtgacaagtacggctaactcacaagttttctcaatctcagtgactgatactaatgcgaaagctagtgcgacgattgccaatcaaattgctcgtagttttaagaaccaagtgcaaaagattattaaagttaacaacgtcacgattgttgctccagccgaagcgccaaatggtgcggtatcaccgaaaagacctcttaatatgttggttgggttagttgcaggattgttaataggatttttttatgcagcgattcggatgctcactgatcgtcgcgttcgcgacgctgatttcttaactgatgaattaggattgattagtttaggcttggttaaccatcaacatcaccattcaatgaagaaacaggccttgaatctgaatggtggctatcatacgcataatgatcgaacatcgtcacaagcgatgaaacgagtttaggagggtgttagatgtttaaacgtaaagaacagactataacgactacgggcccaattaatctcacgacgattaatgaacccatgtcggtcattactgagcagattaaaacaattcgaaccaatatcaattttgcggctactgaccataagttacgaactttaatggtgacttcagcgatgattggtgaaggtaagtcaacagtaagtggcaacttagcagtggagtatgccaaggaagggatgcaagtcttactggtcgatgctgacttgcgacgaccgacgattcataaaacgtttgggcttaaaaatcataagggattgagctcatggttagctaatcagttggacgacgtgaatgatgcaatccatcccgtcattggtaacctattcgtgatgacgagtggtcctaagccacctaatccggctgagctattgggtagtaataaaatgaccgaatttttgacttcggcaacgcgtaaattagatttggtgatcgttgacgcaccaccaattttgccagtgactgactcacagttgcttgctaataaagttgatggcacggtcttagttgttcgccaaggtgtggcccaaaaagcagcggttcgtgatgctgttaattcattaaagaaatcgcaagctaacattttgggtgcggtgctgaacgatgttcgtgatggctctcatcacggatactacggctataacagtggctacgggtactacagcgatgaagataaataatttagttgacttacattgccatatcttaccagccattgatgatggttcaccttccttagaagcgtcattggaattggcacggcaggcggtggctgacgggattcgctatattttagcgacaccacatcatatggatcggcactacctcaatcatgccggtgatgtggcagcggcggttaaggtatttcaagcagagctagatgcaaatgatattccgttaaccatttttcctggtcaagaggtacatctgaatggtcagttgatggaaaatattgatgatttgttgggcatagataccagtagacactatttactgttagaacttccccacgagatggtaccaagttatttggatgagatgatttttcaattgtcttgtgaggggattaccccggtcattgcacaccctgaacggaatgctcaaattattgccgaaccgcagcgattatacaagttggccgaggatggggtcttggcacaggttacggccacgagtttagttggcgcttttggggaacaagtacagcgaactgcaaaagaattcgttaagtgtggtttggttcaagtggtcgcatcagatgcgcatacgctgaaaaatcggggctttgcaatgacgaaggcctatcaagtattaaacgaaatggattcccaatatcctgaacgttttgcaaccaacgctcggaatttgctgaatggtgagcagattgctattggaagagtggtagtgcctgaaaagcagaaaaggttttggctgctttaagaacgtgtttggatactttgacattcgatttgattttagttaaattagatcaaaaacaggagtttttaatccatgaaaagctttgcacaccattatagtagcgacatctctcgtgaacaatttgaactaatccggacagatctagaaggcatacgtaagcggactaagccaagaaaggttgatttatatgatatcttttgtgccctgctttataccttgaaaaatgggtgcgtttggcgcgatttacccagtgattttcctaaatgggaaaccgtctattattactggttactttggactaaaacgccatctcctgctggtatcactcctctggataaggttttaaaaaaattgtcagccaacatcggttggctcagaagcgttcagtttatacatcgttcatcattctagatgctcaaagtgtcaagaataccgatcctgctgaaagtagcggctacgatggtggtaaaaaggtgagtgggattaagcgccatcttgctgtagatatcaatgggctgccgatggcagtccatgtgacaaccgccaatgtttctgagcgtgatggcgccaatgcgctactggcgttaaacaaatcacagtttgacctggttcaacgagtaatggccgatggtggttatactggtaacaactttgctcaatcagttcaggcaatgattaacgctgaagtcattattgctaaacagagtgaccttaggcacggtcaagtgaccccgcaacgctgggttatcgaacgcagttttagctggctaggaaaatatcggcgcctctggcgcaattgtgagcgaaagctgaacaccagtaagatgatgattagcttagccttcctgcgaatactcttgaaaagattctaaacacgttcttagacctactatatcagccttttaaaacaactcactgtttgatttagcctagttagcttactttgtgaaattaggctgatttaagctaggttatttaaagcctgttttgatgggatttagcctttgtgaaatttatttaaactgacctagttagctggcttgtgattttgctttatttattcaatttagttgacttattgggttacccctgctgtaatgcgagggagtgaagtggttgagtgcagagttgtaccctagtcagacggtcaaaataaaatgactatctagctagagtgcaactcacctgttgtaacgctcggtcgttcgggcatcgtttggacaatcagttgcggtattactaccaaccactagtatcaacctacattctcggttaagtccactaaaaaacgccctaatggacgctgatagcacgtatttagttttgttcggttaccagctactagtgatcaccatgctagaagcatcgttttaccacccgggccgttaatggtcgccctcaccattcatcaccagcctgattgtctaaggccttatgtgatataaccggtcgttattgaagtcgcaccggtaaacgtgtccccttaatatttatactctagcttgtcccctagaatggtccgcgagaagcaattgagtcaagacttgcaattttagagcctagaccgtacaattaatacatgattatttgttgttcccacgaaggttagaggtcgcggggcttcttttgtatatgcagttgttttaggtctggcttcgttgctaggccttttttaatacaagcttattgtaacgtcttatttagcaagcgtcaacacttttttaatttagtctacaaatctacatatatatttatctacatgtatttatgtatactcgcatacaaatagataataggaaatagaatgcatttattgctgtttaaacaagcttttatggtagctaaaccgtctacatatctacatatctacatgtactcttgtattttagtctacatatatttttgtatatttgtatatttatctacatgtaaacgtttgataatctgtgctatatgaattataatagtgagattaagggggctagcagaatggtaaaagttattacgtttggaaatttcaaaggtggaactggaaaaacaactaacagctgcatgatttcatacagactagctagacaaggatacaaggtactactagcagatttagacccgcaggctaatgcaaccgcattatatctaaagactaaacaagttcaaaataatgaggttgttaaatttgataatactttaatgaatgcaatcagcaatgatgatataagtactattgttactaagattcgtgacaatctttatttgttgcccagttttgcagactttacatcatatccaattttcttagaaaagaagtacccgaacacagatgaccaatataagcgagctaaacacttttcaaatttgctagataaaattaaagatgactacgattacattatcattgatacgccgccgactgttagtgtatacactgactcagcgttaatggcctcagacagcgttataattgtgcttcaaactcaagaacggtcgtatgtaggtgctgaggcctttatctcttacctgcaagagcttgtcgctaattatggcgcaaatttcagcattgcaggaatactaccggttctgctaaagaacaacagccaggttgatcagtcaatactagaacaagccgaggctgagtttgacaaggataatatttttaaaaatgttgttaaaaatatggaacggctaaaacgttatgacattattggcattgttgatccagatttaaaaacacaaaaacatgatatgcatgatatgcgagtagatgcgctatataagaaaattacaaatgaatttgttgaaagggttggtaaagatgagtaaagacctgctcaagaaaagccttaactcagatgttactcaagttccgaaacctagcaatatattttcgcgggacatgaaagtgaaagcaaacactaaaaagtctaagcctaaaactactacaattagatgctcagttgagacagccgatatggtaaatgcattatccgcagtgcttaattttaaaagtgtggatgagatgcttgaacacacaattaatagcacgctagaaggtttaacaaatgaggaacgtgctgaatatcgaacggtgaagaagatatatactagcagacgctcaaaataactagcaataatcaaaatttagatggaatcgttatactattaatagtagaaaggtaggagaaattaaaatgagttattcagaagcaatgattaagcactactatttaaaagagtttgctgataagtcagaccctaagaagcctgataagattgctattcagcatgagataaacagcctaaaacttaaaaagaagtggttggaagagttcacaaaaatataaaattagggtagattgtaaaattaatccgacgctgttcggacaaaaaannnnnnnnnnattaaacttgtaatttgccacagaaaaaatatcagctacgtattctgatgagttatgggtttaggcctaataattgtgaccgggataaaatatgaggggaaagtgaatcaatctatgaaaaaataattgaggtgattatagtactaaaaacggtatgatagtgatgactctgccaattggtgaataaatatttgctaagcattaactatgtgttaacctagcaatcgcgtaatttaagacatacggttagaataagttataagctgaatgaagcgtaaagagctcgttcttatcacggtcattaagtagaagatagtccaaattaatgaatctttttgtggctatggttacaatggctgctgatattggcccatcgttcgaaagtaagctggcaaattttaggttgctacggtggctttctcgcgtgatttctcacacattccccctaggttttcaccaccgttcaaggtacaattagattagagctcaaattcaagtgaaaaggatgtccgatatgaatgacgattggatcacggtttttcccgcggattataataattcgtaccacttaattttgaaacgggggacggcccattatgcgtactactactttaaggttgataagctagatcaacgggtcattttctatgatgacattgagcgtagcggtatttcaatcaagactcagatcacgcggacgtttatgcgggcactggttaaagcaattgattggcatccggtcggtaacagtattattatcgagatttaccctgtcgaccgtcaagagacgaaggcaatgcggctatcttgtgatatttagctctgaagtgattgccaagagtaagacgactttaaatgataaccaaagaatccccggtcaattactgaccggggattcttgtaattgcaggtaacgcgaggttaagaacgtgtttggatactnnnnnnnnnnagattctaaacacgttctaagcctttggtgcagtgacgattggtgtctcgatggtttcgacgtacttagcggcaagcggttcggcgactaagttttcgccatccttcacgaatagcttggtggcagcgaggtccgccattgccttactaacaacgtctttactcaagttgtcgttggcgtagtgtaacttcaagtggtgaaccttgtttgtgctagtcttaaagcttaagtctaaagttttcatgggcgattcctcctattattatgggcgtgttaagcgatgggttgtggatcgtagcggtaggcgttggccaagttagcggccgtgaactggtcgcccgtcaagacttcgacgatcttgccaaaagcggcaagttgttcgtcagttgcgtcttgggcgattgcgttaaaggtttgcttacgttgttcgtccaattccgtagttgtttgaacagtcagggttgcttttaaccaagttttagtcatgatgagttcctccttgaattttgtggtggtaggctggccagcttacattaatacagacggttgagcctgacgatttgtgcaagggttgcctaaacttttttgactagccccatttaatccgcaaactcggtgatggttcgaacggtaatactgatgagcttctcagcgaatagtggggtcagaatggtaatcaagctagtaaggtcgctgtcggtcagttcgcgatctgctaaccagtgttggtggaattggcgttgattagaatcagttactgtgagcagtacatgtgtgttcatccaaatatgcatcgtgagttcctttcagactgcgacagtcttgttggttaattggtggtttgttgctggtaaagcttgtgggccttgacgagcagactggcccgccagttgtagactgttcggcggctgacctggtggcgccgcatgatactgctaacggtctgttcttcgaaaaagaattcggtgagataaatccgctcacctggccgacattgaacaaggagttctgttaagagggcggttaattgccaatgggtctcttgttcggtcatgggatcaatggtaatgggtagtgcgtgttctaagttgacttgtgactgggtgcgcaaagtttgtttacgtagatagtcgacagttcgccacttgatacggcgaaatgcaaatttacgaaaatctggtaagttagcgggcaattcgggcgcgtagttctggtaagcagacagccaagtcaggtgggccacggttacacaatcttcgaattgcgggtggtatttggtgacttgggcggcttttaaagcgccgtatagtaaccgttggtgctcgggtcgggcgagtaaatcgaaagcaatttgattatcaaaacggtcagcgtgcatctaaataaccccatttatgagcgatttccttggccaaggttgatatcagtgtagcgagcagtcgcaactgacgcaggtcgtgaaaatggactgaaaagtgacgatttattttcattattaatgttccaatgagatttggatagatcacagaccaaccactttcctagattgtacgtaattgttatgatgtgattaatctaaaataaccgcggacagcgggggctcggctggtgaatgttagagataaataccgactttgagggggattttccatctatgaaccaaaatattgacgttccgcatcacgttaacactttttggcagtgccacgctggtacttgggacacccgacagccacaacgattattagtcatcgcgcaacgctcagaacttgccacaatcgacgtgctggagacactttttctacttgacataaaacacctgacatgtgttgaaaatacgctaatctttgatcgtcaacggggattgatcaagacaaaactgacgacgcgccagatcatgatgaattacgctggtcgtctggggttatctgggacacagttgatcaagcaactcgccggtgaactcggtttatcgaaacacaagttacctgtgattcacggtgatgcgatcctgatgccgttaagtacggccaaacggggaacaaccagctggtacaatcggcattatttgaagcatattgaggctcaaggatttatgacggccttagtttatgatggtcaaattacgattcaagtggatatgagcgagcgcgtggccactcgccaacttgcgaaggctggtcaattacaagcagcgctacaggaacatcatcgccggcgattagtgcccgatcaatcggtaccttcaatggcggacacggatcacgagatgatgcagtcgtatactgaccaagtcttaaagcactttggcatcttagcacttcctggagaaattagttgtttgacgcggcgatttttcggtaaactataggagtaaagattaaatgatgggagttggtgtcgttgactaagaaagtcacgaagattgtcgcgcaaaagcgagctggacgttataacatttatttagacgagcagtacgcttttccaatcagtgagtcggtgatgatcaagttccgcgtttttaagggcatggaagttgatgaacaactgcaagcggcgatgattgcggcggacgatgtctccaaggcgtatacgcgcgcgcttgattatctctcacatcaattgcgtaccgaaaaagaagttcatgacaagttacgggatgaagaaattgacgagtcggttatcgacgcgacgatgcaacaattacgtgagttgcggttattgaacgaccaacagtatgcggatgcctttgtgcggacggccaaacggaccagtgacaaggggccacgggtgattcggcagaacttacgacaaaagggtgtgggcgagcagctgattgatgacgcgctggccgggcagtttagtgctgaagagcagatcgataatgccagtgaacttgcgcgtaaactggcaaaacggtatcaccgccaagcttttaagaccatgcaacagaaagttcgccaaggtatgatgacgaagggctttgataatgacacgattacggccgcgattgcgagtttggcattagaacccgacgaagatgaacagtgggaagccctcgttgcacagggggcaaagttgtggcaacgcaatcgcaagtatgcgtttcgtgaacgcatgatgcgcacgaaacgcagcctgtttcaaaagggcttcatgatggacgatatcaatcgatttatcgacgaacaagttgctgatgaatgaaaaggttgaattacctgcccgcacgccataaaaatctggtataatgtttaatgaaattcgatgaaaatttaccctcattttagaaagttgggttaatatggcgcgcgaggctaagggacctaaggaaggcgacttcattacgatcaaaagctataagcacgacggaagtttacatcgaacttggcgcgatacaatggtactcaaaacaagcgagaacgtactaattggttgtaacgatcacacactagtcaccgaggatgatggtcgccggtgggtgacgcgggaacctgcaatcgtttattttcataagcattattggtttaatatcgtggcgatgattcgcgataacggcgtttcatactattgcaacttagcatcaccatacgtgttagataaagaggctttgaagtacatcgactatgatttggatgtcaaagtctttcccgatggtgagcggcggttgttggatgttgatgagtacgaagaacacggtgcccaatggcgttattcggctgatactgatcgcattttaaaagcaaatgtgaaagtcttagttgattggatcaaaaacaaaaaaggcccgttttcacaagactacattgatatctggtatagtcgctatcaagaattatcacgtcggcaatagctctgctgacggtctgtcagcggcgtaattaaagtacaaagggagtgactccgtgctggggtgctcccttttgtgttctggttgcgtctcgacattgaataataagagatgattaccagccgtcatggttgacacaagtcatgataattaggacaataaaaagcggcccacaagtcgcctctgtgggtcgggtgaaaataggaattacacttttaagcgccaaagttgactggccgcgaatagccaaccgcgtgccaccacggaacgtagactttttcatttttgacaccattgtcctgagcgtcaatcatctttccaccaccaacataaataccgacgtgtgatatcgaacctgtgccactaccaaagaagactaaatcgcctttttgggcgcgctgtttggaaattttgggatattgtcggtactgagcttgggccacacgtggtaaggttttctgcgcagcttgctggaagacatacttagtgtaaccggaacagtcgaacgtgttcggaccgaccgcaccatagacatagcgatggccaagtttggatttggccacgttatagaggttagtgaaagatctggtgctcttcttgagggagccggtcttgacccagccacgaacacgggtattagcactcgttacaaaataataattagccgtggtattattagctaagcgaatttgccgttgttgggtgacaaaccaagtggtattaccatattgtcgaagcgttccccgactctggattttaagattatttgcggcaccactcatgttatagaagccgccctgagtattcttcgtcaggtaggcgcttttagtaagattagtggttttaatgacgcgattcgttgagctggcatcgacgtttggtgcttgccaaagctccaccgtgaggcctaaaatagcaacaatcagtgtgataagacgttgtttcatatgtatttcctccccgaaaatccccatgtccatctcattcaataacgctgaccccatcataagcgctcattgtaacaaagttgttgcaaatgagttgcggttcgattaagtaatgtctacagtttgagtggattaacaataattgattagatcttgaccgataggagtgacgaacttggcttttttgaagattgataacggtgaattacttaagaatattcggcaatttgccaagaagaatggattgaccttagcggaagtagcgaccttagcaggcttaagtgcgagtgccatctatagttggaaaaagcacacgccgtcagtcggtacgcttaaggaagttgctcaagtgctcggtacgagttataccaaattggttggtaaggataaagaaccgacagctaaggcgaccaatgccgctgctgttgatcttaaaaaagtgattgaaaacaagaaaaaccagtttgaatacgacggccagccgattactaatgaacaaatgaaaattatcagaaacgtcttgaagtcgatgttcaagaccccacgactttaattttaagtaaaactcggttcttttaggtgcaactgggacctgcttagtgtaaaatattgctcagttacttgaataattgctagcagcgcttgacgggtttgaatgaatggtgcacaatggcaacaattatggaacggattgggagatgggcgtatgaaaaaagttactaccgcattagcaaaaaagaatatcaaccagttgttaacgattgttaatcaaggccacgataccattgaggtggaaaatcccagtacccaagattcagcggtaatggttagtatgaaagactggttgcagattgtcagccaattagccaaaacgaatcatcatgacatggaattcagttaaataataacaaagaactaatcgtgccagtcaaggttcgcttagtccaataagctaaaggcaccaccgacataatcatgtcggtggtgcctttttgaaagtgttagttcgttgacgtttgagtgctgattagtcggtctgactttcagcgtacttggtcttgatataatcagctgaaacttgtaattttttcaattcttcgtccgtgagatccaattgaacttgttcgacgatcccgtcacgaccaacgacggctggatatgaaaggtatacgccgtattcttcccggaaatttgaaacggggagttcggtgagggcgtcattcaagaccgtgttggctaagcgcaccgcggccgttgccacgccataacttgtatattttttgccatggaagacccggaagccaccgtcgcgtgattcggcgtctagtttggtcaaatctaaaccgcggtcagcggctaatttggtaattggttgacctaacacgcgtaccgttgaccaagctgtaaattgggaattgccgtgttcacccaggttgtagccggccacggaccgtgaatccaggtgtagtgcactggcgaccgctcgtttcattcgtgcagagtccagtagtgtccccgtcccgatcacatgattctttggcaacccggtaaccgcttggtagatcgatgtgatgacgtccacgggattagtaatgacgactagaattccgttgaaaccactggctttgattttagcagcgacgtctttgacttgtgtgctggtaaagggtaattctaggaagcggtcattagttggtgaatcttgtaacttaatattcccgatagctgagataatgacatcggcatcaatgaggctgctatagtcattgataatgatattcgtgtgataaggtaaattaggcattgcatcctgaaaatcaagcgcgtctgcttcaactttgctggtgttcgtatcgatgaggacaaggtcatcggcaaagccattggcgacgatgtagtgagcggcggttgaaccgacgtgtcccattccgataatggcaattttacgtgacataatgtagcgctcctttgaaagtttatcgttcattaattaaattaccattattctcattgattttaaatagattttgtgagaaatatcgaaatcgtattcggactaagtgaaatagggtataattaacgcattaatagttgcaccaagaaagggaggagcgcgagtgtttaagcgcctaaaagattcggccttgttattttggtcacttgaaattttgattgtggcgaccttgatctgggtctgcacgaacattggttttttgtttcagccaatcggcacgtttttaagtgtcgtgttcatgccaattttgatttcaggatttttattttatatgttgaatcccttggtcaagttgttgactaaggttcattacaagaagtttcggatttctcgaaccggagctgtggctatcgtatttgtgctattattcgggttactggtgtggggagcggtttccctgttgccacggttagtcagtcaggtgacacaactgatttataacctaccaagtattgccactgagatgcaaaaagccgctactaagctgatcaataatagttcggtactgaaaagaattgatattagctcgtacaccaagcaattcaatggtgaaatcagtaagtattctcagaactttttgtcatcattatcaagtagtgttgttacggtgatttccacgattacgagtgtgacgatcatggcaattacgattccagtcgtattgttctatatgttgaaggatagtgagaaattcattccagctatcagtcggttcttaccgaagaaacagcggcctgaagtcattggtttactacaaaagatgggcgacacgatttctagttatatcagcggtcaggttattgagtgtctcttcgtggggacgtttacggcgattggctacatgttgatctcgcaaccatacgggttattgcttggcgtgattgctggattgacgaacattattccgtacgtaggaccttacattgggatcgcgccatcactcatcgtggccttcaccaagtcaccgatgcaggtagtgtacgtgattatcgtagtcgtgattgttcaacaggttgatgggaacttaatctatcccaacattattgggcggacactcaaaatccacccgttaacgatcattattttattactagcagcgggaaatattgccggaattcttggcatgattttagcgattccgttctatgctgtggtccggaccgtggttatttacctctataatattgtcgagttacgaaatgaggagcacttgcgtaagcaaacgacggtctatcagccgcaacctgctaaggcgactaaagcagacttgacgacgaccactaaatcaaaaaagtagtctgtgctataattggtgaattaagcttgaacgtggcataaggagtgattttttgaagaaagtaattacgtatgggacattcgatttgttgcataaaggccatattcggttgcttaagcgtgcacgggccttgggcgatcatttgaccgtttgcgtctcgaccgacgaattcaatgctgagaagggtaagcatgcgtacacctcgtatgaggatcgtaagtatattttgcaagccattcgctatgtcgatgaagtgttacctgagaaaagctgggatcaaaaaatccgggatgtcgttgataacgatattgatattttcgtgatgggtgacgattggcgcggcaagtttgattttctaaaagactactgcgaggtggtctatttgccccgtactgaaggcatctcatcgacgcgtatcaagcacgatttagggatgcaatccaaggattaaccactaagctaggatttatcagtcacaaaacaccgccgttacccgcaacttcaagctgcgtaacagcggtgttttaattaacagttattagtaagtcacgcctaaatgaccatggactggttcgatgcggattatagttagcattcagccagttcaaagggcttaatggaagatggcgttgagcgccaacacgcctccgagaccgcagacagcgatgatcgtttctaacatcgtccatgtaagcagcgtttgcttgacggtcaggtcgaagtattcccggaacatccagaaaccagcgtcgttcacgtgagaagcggcgacactcccagagccgatggcaattaccatcagggcggggtcgataccagcttgcgtcattaacggcgcaactaggccggctgccgtgagggccgctacggtagcggagccgagtgagacccgtaagatgacagcgactagccagccaagaatcagtggtgagatgctgctgccactgaacaactgggccacggccttaccaacacccccatcaattaagatctgtttgaaggcgccacccccaccgatgattagtaataacatggcaattgacttagtggcatcttcgatggtggccgtgatggccttattggtcttgtgttggtgaatccccattgaccagagggcgaataatagtgaaattaacatggcaattccgggtgccccaatcaaacgaatgatttggtcaagggtcgacgggtttttaggtgtcacaccgtgatcaacgactaattcgtagacggtggtgattgtcatcagaatcacggggaagagcgccgttaagacactgagtccaaacccgggtgcttcagatactttgaattgacgtttgttactgctaagtggcaggtgtggtttaccggtgaatgcgtcaggaaccatcttttgcgcccagcgtgaaaagagcggtcctgcgatataaacagttggaatcgcaataatgatcccgaatagtagcacatgacccacgttcgcatttagcgtcgtcgcaattgcagttggtgccgggtgcggtggtaagaatccgtgagtgacagataatgcggcgcccatgggaatccccagatagagaacgggaacttgtgcttcgatcgcaatggcaaagacgattggaatcaacaagacgatcccaacttcgaagaagagggcaatcccgatgataaatgaggcgactacgatggcaatttgtagccgtttgcgcccgaaaatatccaatagtgtcgtggaaatcgtgtaagcaccaccagcatcggctactaagcggccgagcatggcaccgaagccgaagactagtgctaactcacccagttgactgccaatcccgttctgaatactagtagcaatcttagttaatggcatccctagtccgattccgacgacgacggccgtaacaatcagtgcaatataagtattcagcttgaatttaataattaatagtaatagtagtaggatgccgagtgtaagaacaacaaatggcatagtggacactcctaacgatttagagtagcaatttcgtgatataacggtgccaattgcaccgttacgtggtcaaaaacgacttggtgttgatgatataactggtggttggcggcgttgggttgataagtttcggttgcaccaatcatggcgtgaatcgcggttaaatcatcaatatgccccagtgccttgagtccaatcacggccgctgctagacaggaactttcgaagctcgctggaatcgtaatgggttgtcccaatacgtcagtcaaaatttgccgccataaacttgaacgggcaaagccaccagtggcccgaatcgcatgaactggttcggcggctgccgtcaattgtaggacagtattcaggttcatcacgataccctctaagaccgcacgtgcaatatcggctttggtcgtggtcgtggtgacgcccagcagtgaaccgcgggcatccgcattccagagaggcgcgcgttcaccacttaagtaggggtgaaataagagtccgtgggcaccgacgggaacggttgcggcaagcactgtcaattggtcgtatggatcttgttgattcgcacgggcggtttggctttcagtagtgaagagttcatcgcggacccaccggaagacttgaccaccgttattgattggcccaccaacaatccagtggtgcggcgcgacgtagtaacaaaatagtcggccttcaggatccaagtatggttgtttcgtcatcacccgtacagcaccggaagtgccaatcgtaatggccgcaactcctggttcatcagcccccacccccaagtttgaaagggcaccgtcacttgcacccatgataattttcgttgtgggtgcgagtcccagggttgatgctgcgactggtgtcagtccatcgatcacggcgtcggtatcgaccaatggtggtagctgcgtgcgggtgatgtgtgcatagtcgagcgcgacaggttcccaatcgaagttataaaggttgaataggccagtggcgttggccattgaataatccatttgaagttggcccgtcattttgtaaatcaagtattctttaattccgaccacgtgacaggtttgtgctagtaattccggtgaatgatgggcaagccagtgaagcttaaccaggggactcatcgggtgaatcggcgttcccgtgaggtggtataggcgatcgcccaggggttgacttttcaattcagcggcgtcttgtgcggcccggttatctgcccaagtgatgacccgggtcagcggttgtttctgactgtcaagtaggatcaagctgtgcattgcggatgaaaaggcgattccttcgatgtcttcgggatcaatgccagcacttacttgatggatggtcgcttggactgcctgccagatttcttgcgggtcctcttcggccgtggtcacagtatcatgatagagtgggtagccaacgttggcactcgcaattacgtgaccctggtggtcgtacaagacggatttggtacttgtggttcctaaatcagttccaataaggtaagtcatggtgcttcgttcctcctattcgtgatcgacagcgtggccaccaaactcgttacgcagggcggcaacaactttaccagtgaatgtgtcatcggtttctgaacggtagcgcatcatcaaggccatcgcaatgaccggggtggcgacttgttggtctagggccgtgtctaaggtccagcgaccttcaccggatgaatgcataacacccttgatgtcatctagattaccatccttgctgaatgcatcttgagctaagcccattaaccagctgcgaatgactgagccgttattccacattttggcgacggccgcgttgtcgtaagtgaactgactatgctgtaaaacgtcaaagccttcacctattgctgccatcataccatactcaattccgttgtggaccatcttcaggtaatgaccactgccaacagggccggtgtacaaatacccatcgggagcggcaatcgctttaaatagtggttcgacgacttggaaagtggcgaggtcgccaccaatcataaaattgccgtcgtggcgtgcaccagcttgaccgcccgacgtcccgacgtctaagaagttgatgtggtgacttgccagtaattcgccgtggcggatactatcttgatagtgcgaattaccgccatcgaggacgatgtcacctgcacttaaagtctgggctaactgttcgataacgctgttggttgccttaccagcgggtaccatgatccacacgatccgtggtgttggcaactggtcaagcaaattggtgagatccgtggccgtcgccaacccgtgagcactggcggtactaagattagtggggttaagatccattcccactggcgtgtgcccgttatcctgcatgttcaacgctaagttcattcccattttacctaagccaatcaatcctaatttcatgatgaaacccctcttttatggtagattgcaaatttaannnnnnnnnnaattttacaatctaccttatatgaaaaatattaagtactttttgtattcgcttacattgtaatgaaactatttacataaatcaaccatatatttgtaaattattttcattagactgaaaataatggcaaccaagcccggttttacaggcctgattgccaagaaaaaatttgttaaattgctgaccaaacggctgcgccgatacttgggaagagggtcacgagttgttcacgttgcgccggtgtcaattgatactggatcgctggtagcaacgtgttaatggtattttcggcctgttcaccgagttcagcggcaccaatcaaccggtgctggtcatccgtcacgagtaagttatggccggtgacatcgcgcgttgtctgccggaaccagtcatcctttaaatcattgacggtaactttgacatcatgagtgtcactggttggaagtgtaccaacttgggccaatcgtggggacgtgaagacgaccgatggaatggccggatacttgatgggggcattggtgtcacccgtgaataggtgggtcaggtattgcgactcaaagatagcagtgggtgttaattttggttgatccttggcgagaacgtcaccggatgcgtagatgccagcgacactcgtttgcaagtggtcgtcgacggtgattccagctgctgtgtagtccacaccgattctttcaagtcctaagtttgcggtgttgggctggcggcccgtcgcatctaagatccagtccgttgtaatcttgtcatccgcactgaggacttcgaagtggtcaccagtcgacttgatcgcagttggcacccattcacgttttaggactaaaccttgttccacgagaatggccaataatcgttcaacgaatggttggtggaattgacgaagcgcttgatcaccacgcatgagtagggtgacctgactgccggctgttagtgccatgttggcgaattcgagtccgatgtagccggcaccaatcacggtgatgtggtgtggcaaagtggttagattcaaaaagtcgttactgtcatgggcgagttcggtgccgggaatgtccaaacgatgtggatgctgacctgttgcgatgacaatcttatcggcggtatacgtcttgtccgccacctgaatcgtatggtcgtcgacgaacgtcccgcggccattgatgagggtcacgccggcactagtcattaagccagcaatcatatctggtaagccggcgatgacgtcgcgttcgtggtcgaagttggcttgccaatcaatcgtcggttcaccacgcagaccgtatccttggaagttagcaacttgattttttaatgctaccggctggtctaaggtgattttagcgttgcaaccccgattaggacaggtaccaccaatcaaatcagcttcaatgacggctacttttttgccacgagccgctaacggaatggccccgtcaaacgttccgtgaccgctacctagatatacaacgtcaaatttttctgacatattaaaatcctcctcgttcccaaatcacagttatttaaaaacaaatacattgtacacaacttaatttaacatgccaaataaaacgcggccttaatttaaaagtatggccctgaaatcgattgcaactggtctgtcatgactttgttaagtgaattcccaccgaatcggtgcaagatagtcggtggtactggattttttggtcaaatatcagtaaaatatgtaaggctatgtttttttacggtgggacggtaccaccgtgcacgttgaatatacaggttatgatgaaaggaatttttaatgaataagacagaattaaccgccgcggtcaatacccggcgtacctttgcgattatttctcacccggatgccgggaaaaccaccattacggaacaaatgttattgtttggtggcgttgttcgtcaggccggaacggttaaagcccgtaaaagtgggaactttgccaagtctgactggatggaaattgaaaagaagcggggaatatcagtaacgagttccgtgatgcaattcgattacgatggcaaacggatcaacatcttggacacgcccggacatgaggatttctcggaagacacttatcggactttgatggcggtcgattccgctgtcatggtcattgactcggctaaggggatcgaaccacaaacgaagaagttattccaaatttgtaagatgcggggcattccgatctttacgttcatgaacaagttggaccgtgatggtcgcgaaccattggacttgttgaacgaagtcgaagaagtcctcggaatcgaaacttatccaatgaactggccaatgggtatgggtaagggcttaaagggcttatacgatcgttacaatcaccgtgtggaactttatcataatgaagctcatggcgaaacgttcttaccactagacgagaacggtgagcttgatcctagtaatgaattgaccaaggacagtatttatcgtgacacgttggatgaagtcgaattgatcaacgaagctggtaatgattttgacgaagctaaagtaatggcgggagacatgacgccagtattttttgggtccgccctcaccaatttcggggtcgaaacgttcttgaagacgtatctgcagtatgcgcctaaacccgctgctcataagactcgtgatgaccaagtcgttcagccaaccgacgatgaatttgccggttttgtgttcaagatccaagccaacatgaacccgaaccatcgtgaccggatcgcttttgtccgcatttgttctggtgaatttgaccgggggatggacgtggtcttgcagcggactggtaagaagatgcgcttaaacaactctacgcaattcatggccgatacccgtgaaacggtggaaactgccgttgctggcgatatcgtcggcctctacgacacaggtaacttccaaattggagatacgatttatgctggcaaaaatgcggttcaattcgaaaagttaccgcaatttacgccggagctcttcatgcgcgttacagccaagaacgtcatgaaacagaagtctttccataaaggtattgaacaactggttcaagaaggtgccgttcagttgtacacttcatattcaacgggtgactatattctcggtgcagtcggtcaacttcaatttgaagtcttcaaattccggatgcaaaatgaatataattcggaagttgtcatggaaccaatgggtagcaagactgcccgctggatcgatcccgaacaattggatgaaaagatgtctagttcgcggaatctattggtcaaggaccgctacggggcaccgctcttcttattcgaaaatgcttttgccgaacgctggtttgcggataagtatccggatgtcaagctgacctcgaagctctaggatttatattgtggtttacacttagctgaccaatctagttagattactgttcgtcagtcgatgtgcgtcctatttcgacctccggggctgggtgactattgctggaacgtaagccgacatcaatttgagttaacgcacaacccgcgttagctcaaatacgagtcttattctaagccggaagaaaatcactccagctaagaataatttggctactgagcattgcctagccaacggattaatgcggttttggcattagtccgttggcgtagcaagcacaggcttcagtggcaccgatcacgtttcgggaacccgctcgaatggctgatgaacggccacttaacttggtgcaattgggcgctaactattttgatactggaactttgaataaaacatcagggtgcataaacgactttgtcgcacattcaattttgactacagcggcttaagatagtgagctattccaatatcattttcagtctgatagttgcttagcgaaattaccgtttatgaaaaacaacgaccaattcatcaaaaattgggcccctcaccgtctgctattcgaatactatcccgactggaaggcgtttcggccaatgctcagcggtgaaattccacttagcaagcgtccttggcttggttagtggaagaccagtatttaagacgtggtcttcggcttaaatctgtgtccaccgcgttccagcaattggcagaaatgcctggaagtcggtgtaggacgcacctaccaaaaaagtttacgctaactcgaacttttcccagcgggcctaagctggctgctcttgatttaacggatagaaaagttacaacgtgtctcaagcaaaagcacgaacaaatatgtgaataattcataaaatgatggggctgccaagttgatttggcggtgtcatcattttttggtgggtggtaccggatagaagcgatatgagcggttcttctaacatgcttatcggtccatgtaaattcaccatgtaaaccaacgttgtagcactgctaaggtgagagaattacgatacaatcaacctgcaatttagattgtagggggcgatgagattgaaaataaagggacgctggatgctgggattgatgttaggaatggggttgtgggggccggtgacggtgcatgcggcgacgaacttggtacggtggccagtggtgcaaagcttagcgccccggaattgtgaacttgaatcgaaacaaacgcgcttatattaattaaatcgtgcaacgatgcaattaacgccacgtgggacggcccggacgactagtcactggcaacgggttggtcaggtgatggtgacacaaaacaagcggttagtgacttattggcaggtgcgtcacgggactgctgggcgactgagctgggcgttggcggacaccgtacgagttgtcggaaccagggtcactgatattaagacacccacgcggcaaccgatgcgcgtggtgacaacggatcaacaggaacatggggtgacgcgcgcggccaataagctgagttatttgcccttaaaaggggcgggacggtacaccactgagcatattttgtttcgtcctaccgccgcgtatctagcgactcaagggctacaaaatcagccagacacgttgcgccagagtagtggctatcgcgaccattatcatttcaaaacagcactgtatttaccgcaacagttagggagccgcttgttgaatgacccacagagtgcgacgttttcagctgacaatcggtacttgtacgtcatgtacgtcaatgatcaacagttgggtggcgccgaccagactggctgggtcgttcgctatgattggcaacgcctgatggctttaggggctgggcaatcagggaagatggcgatggtccgagtagcagcagctcaccaattcgacgggaagatgacggcttttgaccgtcgggtgctggccgccattgaagtggggccggagtttacggcgggacacgttcagtcactagctttaaatcctaagacgaacgagctgtggtttatttcatcgacggcacgtgatcagcttgcaagtgttgcgcgactaaatccgcaatccctgacgccggatcttaaaattgcctttactactggtagcgggcgtctaggtgatgaactgacttttgatcgcgctgggcaggcctattattggacgcatgcgagtcagctcagaaatggcaatgtcacgctttatcgtggcacaatcagttcgacgactggtgtacattttgaacaactcgcgcaggggttagctaataatccgggtttcttcgcccaatcgattggatataacgagattactggtcggctctacctggtctccgatgagagtattacgtcacttccagcggctaaactgggacacttgacgactagtcaggtcggtgaggcgaactttgctggtgatcgcgagtttgaagggttagtcttcatgcaccacagccaggaaggtttcttgctgacgaatcggggcatcgagttgatgcgcataattgttgataagtagatattaaaatgcgccactcgctagattagattgaagctagcgagtggcgcattttagcatggttcgcgttaatcgaacaaaagtcttgtttaagcaaacggtgggtctaatttcgttaaataacggcccggcaagtaaccttgatcttgcaggcgataccagacgaccccgttgtcgtcggccgttcgctcaatcaaattgaccgtgtcaccatgagtgacggtggttaaatagcggccatatggttcgatgtatgtgtggacctgtttgccagggacaaaactgacaacgccggtttggcgaacaggccgtttattttggacgcggtagccggctggcaacttgagtaacagtgtgtcactggtagttaattggaggtgcgtctccggaatccactgatcatcgccaatcgcataccaggtctcgtgagtgactaagcgaacgcgcatgtacgttttataagtgctaccgggctggagcttagttaaatagttggtcgtagttgccccaggatacggataaacggcggtcaacttgttgacttggacaaaaccagtactgaggtcagtttgctgccaattttgattgcggtagaaaaaaaggaccgtcttggaagtggtcgtgtattccccagtcacgtcgcctacggaacggaggagcttaaaaccggcgacggtcggcgcactgacttcgtaaggggttcctaatttcccccggtacatggtcggccggccaattagttcgcggcggtcaatgtcataggcgtacatccagactggttggccagcttggcgttcgtaagtcaacgtgatgctagcctgtggggtcgtaaaccagcgagtcaagccttcgatatggacgaggtggtagccggtgatgctgacggctggcaagtgaatctcttcgccaatggtgccagcaatcatatcagcagcctgcagttcattgccatcctgatctaggtggtgaacgagaactaatgcttctgtttggttaactgtaggtgctgcggcagtttgtgcggcaatggaacgtggtgcctcagtagcgcttgtggcggcttccgtgctgtttagtgcctgaagtattcctttaagtcggtcaagaaacgacacgtgaccactcctttcattaataaattaattatcactagtataacgcattcacaagggttctggcacgtcttaaataaattgtaaaattcccgctttgtcagtcgtgtatactaatatttaataacagggggcgttaacggatgaatctaaaacaattacaatattttttggccgtggcagaggaaggtcagatgacagcggccgccaaacgcttgcacgtggcgcagccaccactgagctatcagattaagcaattagaacttgaactaggcgtcaccctcttcaatcgcttgcctcagggtgtgactgttactgaagctggcaagctactggtggggtatgcccaacagctcacgcagttgtcggcgactgcggagaacaaggtccgggccctggcacacggcgtgacggggaccattaatctggggacagtttcatcctcggcaggggtcatgccgaatacggcattactaaagtggttagggcaacatcccgatgttcagcttgcgattacggaaggcaatacgtatgagttgttagacgatctgcataaacggttgctagacgtggcggtgttacgaacaccgttcaacgcgcaacatctagtctgtcgttactttcccgcagaacggatggcagcagtcattccgaagcgatattcacggtttgaaaagcggcgccagttacaactaagtgacctcgctacgttaccattgatcaagtaccgtcgttttaatgaattattccacgttgcctttctggaagcgtcggttacgccgacttacatcatgacttgtgatgatgcccgcacggcgatgcactgggctaatcaccaattgggagtggccctggtgccacggtcattggctgaaacctatgacggtggtgacgtgctgattcgatcattggcggatcatcgttttcagactcaactggccctagcaacgaccccggaagccttagcgaccccattagttgccggtttgatggcacaattccagcaagcgcagtcgctagactagtttaatcagtttgatatctaaaaatttaatcgcggttaagggtggattgctgatttaatcgggttgttaccgattacactagctagaaattgcagtggtattttcagacgcaaaataatcctaatgactgtcgtactggggatacgctaaccttcatttaataattagatatcaatcggtttaaatggtacactaacaattgaaatttaaagggtgaaggtgaaggaaatgatttattcgttagggctaatgctcggcgttggggtaattgccggaattttcggtgctattttaggtatcggtggtggcatgatcgtcacaccaatcctgacacttggtttgggattagatattaagtatgcgattggggccagtattatcgccgtgattgccacgagttcgggctctaccattgcatatttacgtgatgagatgttgaacttacgcgtcgcgatgtttcttgaaattgcgacgacggtcggggccgtcctcggggcagtgttgacgggggtgcttaatgcaacattcctgtacttcctatttggggcgctgttagttttcacgacgtataatatgattcgtaaattaatgagtaagaacggtgaattaccgtcagtcaaagatgacaagctggcgacacagttgaacttaaatggtacttattatgataaagcattgaataagcaagttgattatcaggttgaaaacgtaccgggtggtttttccatgatgttcggtgctggtttcgccagtggcttgttggggatcgggagtggcgcgttcaaagtgctagccatggatacgattatgcatatgccgcttaaaccgtcatcagcaacttctaacctgatgatgggggtgacggcggcagcgagtgcgatggtctacttctttaatgggtcaatcaaacccggaatcgcggccccattagctatcgggattatcgtcggtgccttaatcggctcacgaatcatgacgcggctcaagccacgcttgattcgcatgatctttgtgcccgtgatgctctatctgggaattcaaatgattgctaaaggattcggggtgaccatctaatggataagcaaaaaacaactaaagcgcaagagatgcacgccgttgaaatgatgattgggtatattctacgaattggcgtcattgtttctgcaatcgtgattattattgggatgcttctgatgttgattcagggcaatggtggttatgcaaatggtatggaaccccatacggtcgctgatattctagccggcattgtggcacttaaaccatatgccgtgattatgttaggtttatttctattgattttaacgccaactttgcgggttgcggtctctatctacgcctttgcagtggaaaaagaccacttatatgtttggattacgacgattgttctcatcatcttgattgttgcttcggtgattgggtatctcggtaactaggctagacggagctgattaatcaggttgagtcgtgattaaaatgggcgcacatctaaaatggctaccagcttgtttcgaggttaatgtggaaagaatctaagttggtgtaaattcacgggctagtgtgttttatgccgatgtacgagtacttaactagccaatattgtttaataataagagaatgctgataaaaaatcagcattcttttttatttgtgcacttttagctgttttgactaacgtaaaaaagacctaatatcgtcatttttatcgttatttgaattatttattaagaaaaattgccgattgtgttcacttgataattgaacactgatgtgagaatataattgcttatatatcagtaatttcaggcatgtttatcagtatggataataatcgcaaaatgaaataattaagaagattatgacgaaataatgataaaaattagagtttgggattgattttaatttatttataatatacaattactttaacttttcgagggaaaagcacacacaaactattttaaagttaggggttgggttatatgaatttcaaaacagctgcaaaagtaaccgtcgttgccggcgcatccgtactattcttagctgcttgtggctcaagcaagagttcttcaagttctaagcaaacggccaattggaccgaatcagccgaattaccaacgatggacatttctaagtccaccgatgtggttagttctaacgcgttgaataacaccaatgaagggttataccgtctcggtaagaacgggaaggtcacacccggaattgcgaaatccactaaggttactaatggtgggaagacatatacgttcactttacggaagaacgcaaaatggagtaacggggataaagttactgccaaagactttgtttatggttggcaacggaccgttaatccaaagactgcgtcacaatacgcatacttatattcagggattaagaacgctgacgctatcgtcaatggcaagaagcccgtttctagtttagggatcaaggctgatggcgattacaagttgacggtcactttggataagccaattgcttactttgacaagctgatgggctttgtcaacttcttcccacaaaatgaaaaagtggttaagaagtacggttctaagtatgggacgagcagtaaggccatggtttataacggcccttacaagatgactggttggactgggacaaacttgtcatggaccttgaagaagaataacgattattgggataagaaagctgttaagatggacagcatcaagtaccaagtcgttaaggatccttcaactggcttgaacttatttaattccaataagctcgactttacgacactttccaacgaacaagttaagaattataagaatgataagaactacttagttcggaagacggcttcaactttctacgttgaatttaatcgtaaggatagcgataagactttagccaaagctttccagaacaagaagattcgtcaggccttgtcattagcaattaaccggaagtcctacgttaataatacgttaggtaacggttcgaccgtttctaaaggttacgtttctgaagacttagctaaaaacccgacaactggtaaggactttacgactgacgctgccgttccttctgcagttgactacaacttaacgaaagctaagaagttgtggaaagaagggatgaaagaaattggtgaaactaagctgaacatcaagcttctttctgacgatactgatggtggtaagaagtctactgaatttattcaaggtgcttgggagaaattacctggtctgaccgttactaaccagaacgtcccattcaagacccgtcttcaacggtcacaaaacgggaacttcgatacggttatctctgcctggaatgctgactttaccgacccaatttccttcttgtcactcttcacgtccgacaactcatacaacaatgggaagtatgacagtgccgcatacgacgatgctgtgaagaaggcggaaggtgccgatgccaataacaagactgcacgttgggctgacatggttgctgctgaaaagcaattgatgaatgatcaaggggtcatcccaatctatcaacaagcctcggcaacgttgactcggagtaatctgaagggcatcatctacaacactgcgggctcaaactacaacttcaagtacatgtccgtaaaataatgatgtaaatccacagaaaaaagtgtgtgtgctttaactgaatgaatgtgaagcaaaggggtaaggattgacacattgttaatccttaccattttgttttataatgagggatgtcattattttttaagttgattttaatagaatgcgaggaattctcatgagaaagtatcttttaaagcggatattttacttgttcctgacattattcattgtggcgaccgccacgttcttcttaatgaagttaatgcccggaacaccgctgcaaaatgaagctaaattgacccctagtgaaaaggcgtctatcttggcccaatatgggttggacaaacccgtttggttgcaatacttcatttacattggcgggatcttcaaggggagcttagggctatccttccagttctctgatcaagccgtcagttacctgattggtagccggatgggaccatcaatgcagttaggtggccaagcgatggtcgtcggaatcgtctttgggattatcctaggggccgttggtgccatcaagaaggatacttgggccgaccgtttagcaaccatcttatcgatcttagggattgcagttccaagtttcgtgttagccatcctgttacaatactacctcggcttaaaggctggttggttcccagttgctggctgggaaggcttcgcttacacgatcttaccaacgttagctttggccgccagtccgctggccgaaacggctcggtttatccgaaccgacatggtggacgtgctgagttcggattatattgagctagctaaagccaaagggttgtcgaagtttggtatcgtgtatcaccatgcgttgcggaacagtttgattccaatggttacgctgattggaccattggccgccgccttgatgacgggttcaatggttgttgaaaatatcttctcagtacctgggattggggaacaatttgttaaatcaattctggttaacgactacccaaccatcatgggtgtgacgattttctattcagcactcctttgcttactattattgttgaccgatattgtctacggaattattgatccgcggattcgtttaaatggaaatggggactagttaatggcagaaaatccaagtagtatcgatattaagcccggcgacttcgagccgttagataaacaagcgggtcctgataatgaacggatcgcagcaccttccttaacgttcggccaagatgtatggcggcgattgaagtctaacaagaccgcttttatcagctttatcgtgttagtattcttattcttagtggcatttggtggacgggcagtctaccatgttgatcctaatgcacagtcgccacggtatgcgaacctccctccgaagattccgggtgttagtatccatggtttgaatggtcacttgactcaatctggtaaggacgttgatgcgtatgcggcggctggtgcaaagtcggacgtgcattatcttctcgggactgattatctgggccgggacttactggcgcggattatgtatgggacccggatctcacttgaaattgcgttgattgctactttgattgacctgacgattggggtcggattcgggatactctccggttggaaaggtgggcgcgtcgatttattcatgcaacgtgtgattgaaatcctctcgtccatcccacaattggttatcatggtgttgatggccacggccttcacgaagactgggatggcctcaatcattgcggctatcgcgatcactggttggaccacgatggcccggctgactcgagcacagaccttgcaattgaagaatcaagactttattttggctgcacggacactgggtgaatcacccgtcaagattgcttggaaacacttgttaccaaacctttcaagtgtcattattattcaaacgatgttcacgattccaagtgcgatcttcttcgaagcgttcttgagttatatcgggattgggatcagttcaccacaagcttcattggggacgttgatctctgatgggcagaagaacttccaattcttgccatatcagatgtggtacccagccatcgtgctgattatcttgatgctcgcctttaacttgttaggtgacgggatgcgcgatgcgtttgatccaaagtcaaaacgttaggaggacggcagcactatggaaaaaccagaaaatgtgattgaggtccgcaacttggaaatcaatttccatacttatgcgggcgaagttaaagccatccgtgacgttagctttgatttacgtaagggtgaaaccttggcaattgttggtgaatcagggtctggtaagtcagtgacgacacgttcactgatgggcctgttagcacctaatgctgaaattaaacgtgggagcattatgttccacggtgaagatattattaaaaagtccgaaaaagacatgcaacacattcgtggtaaggatattgccatgatcttccaagatccaatgacatcattggatccaacaatgcggattgggatgcagattgcggaacctttgatgaaacataagggtttgaagaaaaaagaagcgattgcccaagcgctagagatgttgaaattggttgggattactaatcctgaaggccgaatcaatgattatccataccaattctcaggcgggatgcggcaacggattgtgattgcgattgcattggtctgctatcctgaagtcctgattgctgatgaaccaacgactgccttggacgtgacgattcaagcccagattctggacttgatgaaggatttacaaaatcgaattgatacgtcgattatctttatcacccatgacttaggtgtcgtggccggaatggctgatcgggtcgcagtgatgtatgccggtaaaatcgtggaatacgggacagtcgatgagatcttcttcaatccacaacatccttatacctgggggttactcaattcgatgccaaccttggatactgaaagtggctcattatcagcgattccagggaccccaccagatttgttggaaccaccagttggtgacgcctttgcagcgcggagcgattacgcgatgaagattgatacggagaaggaacccccattctttaaggtttctgatacccattacgcggcaacctggttgcttcatccagatgccccaaaggtaacgccacctgctgaaatcgttcggcgtcagcaaaagtttgcggccatgcaaaaaccgcaagcaccaatttcaaatcccgtagcaaaggagtaagtagacatgcctgatgaacgtaaaaaaattctagaagttcgccatttaaagcagtattttaatgtcggcaaaaaagatgaagtccgggccgttgatgacgtctcctttgacatttatgaaggtgaaacatttgggttagttggtgaatctggttcaggaaagaccacgaccggacgttccatcattcacttatatgaaccaactgatggtgaaatcatttttgacggtaaggacgtttccaaattacacactaagaaggaacgccatgaatttcgccgggagatccaaatgattttccaggacccatacgcctcattgaatccacgaatgaaagtcaaggatatcgtggcggaagggattgatattcacggtttagccaaggatgatgcagaccgaaccaagcaagttgaagacttattggagacggttggtcttaacaaggaccactctagtcgttatccacatgaattttcaggtggtcaacgtcaacggatcgggattgcccgggcgttagcggtagagcctaaattcatcattgctgatgaaccaatttctgcgctggacgtttcgattcaagcccaagtggttaacttgatgaaggaattacaagttaagcagaacttgacttatttatttattgcgcatgatttgtcaatggttaagtatatcagtgaccggatcggcgttatgcattacggtaagattctggaaattgggcctgcggatgaagtgtataatcatccgttacacaagtacaccgagagtttgatctcggcggtgccggtacctgatccagagtttgaacgtaaccgtaagcaggttccttatgacgaaacgaccgaacatgacggtaagaagcggcgaatggtcgaaattgcaccagggcactttgtccgggcaactgaagacgaaatcccgatatacaccaagcgggctgttgacgcggggttaattacggaattttctgagtaacggctaataaaacagacggcgagtgcgaatactcgacgtctgttttattattcagtagaatatttaattaactgtttagataagtttattaattaataaccattataattaactcatgttaacttgacatataaatttaatatgtaaaaaatattgatggaatcaattgtcaaaaagccgattaaatcggggatagacggctatttttgaccagctaaactgtgaccggtagtcaaagttatttgtgtaaattttgtaattatgcaataataatattgttaataaagtttgttaacaaatataactattcgtcttaataattgattcgcaccatttttaaaaaaatattgcgagtgaaacgttgacttaattgaggtcgtcaaggatacggttatcgagcggcaatgacgaatcgtatcaaaaatattgatttaacaggaatcaattcgcactatttttttaaaaatcatgcgaagggacaatggcttgttttgaacggttaatgaaaaaagtacaaatttcaggaaggatgctgttagtatgcaacaaccaattaattatattatgaatatcatgcaccttgaacgggacttaaaacgacttacgtcgaactggtcgtccgccacagggcttagtttgaacgagttacggatcttagtttatgtcgaacaacatcctggtatccagattggtgatgtggcaaatgcgttgaatgtggcgaaagcctcgttggcacaaaacattggcaccttaataacccaaggatggttgaaaagtcaaccaattaaacaagaccggcgtttacgggtcttaacgcttacgaaggctggtcaggatcgaatgaaagatgttgatgcacaattgactaaatcacttgacacgacgccagcaacacagttagcggatcaattatcagctttgcaattataggcagatgtacacgttcacggatattaagtgaagtaatatccttaacgcgggataaaggggagactctttgtcccgcgcttttgttttagcacttaatagtggggagcattataggttaacaattactttgtttagtttactctaggttaagtaatttaaacttaataagattgattgaggtgtaatggagcgtatgcattataatgttgaaccgctaagaacggaccaagaaatcgatgattttttatgggctgtttcacaagcgcgttatggggagcgtaatcgcatgattgttttggttggaattaacacgggattacgaatgagtgatattttacgactgaaggttgggcaagtacgtggcaaagatcgtgttatgatcatggaacaaaaaacgggcaagaagcgctggttgtttttgaaaaacctcaaaacggaattagcccactttacgcggtatcggggggcaaatgaaccgttattctgtagtggtcggggcggagctttaaccgttaatggtgtctatcgagtctttcagacggccggtgagtacctggagcgggatgatattggtacgcacacgttgcgcaagacatttggcctatcattattatcaaaagactcgtgacattgccggattgatgatgattttcaatcattcgagcgagcaggtgacaaaacgctatattggcattgagcgtgataatttggaacgacaattatgggactttaaattaggcgtttaattatggcagagacgcgggctattcatagcgactcaatgaggatttgaggtaggcacaaaaaagagccagaagtgtaaacgattgtttacgcttctggctctaaatttaattatcttattcggacttcgtctcagccgccaaaacaatcttgccgtcttcaacttttgcaaccatgttcttaacgtcgccgtggtccaaatagaaatcggcgatgcgatcttcgatttgttcctggataacacgccggagtgggcgagcccccatctgagggttgtaacctagttcaacgagtttttcctcgacaggttctgtgacgtggacgtgtaagccttggttagctaacatgccgttgacatcttcgatcatcaaaacaacaattttcatcaagttttccttagataaagcgttgaattgaatgatgtcatcgaaccggtttaagaattctggcttgaagtagtccgtcaaccggctagtgatatcgtgcgtcttgccttcagcagcggcaccaaaaccgacattagcttcactgtcgccagtcccagcgttggaagtcatgatgatgatcgtatccttgaagctgacagtccgaccttgtgagtcggtcagccggccatcatcgaggatttgcaaaaacatgtgcatgacatccggatgagccttttcaacttcgtctagtaagactaggctatatggatgacgacgaacctgttcagttaactgaccggcttcttcatagccaacatagccaggcggtgaaccgatcaacttagccactgaatgtggttccatgtattcactcatgtcaaaccgaatcatggcgtcttgggaaccaaacagttccttagcaagttgtttagctaattcagttttaccaaccccggttgggccaacaaacatgaaggaaccaattggccggccagttccgttcagaccgattcgattacgccggatggcccgggcaactgcttcaaccgcttggtcttgaccaataaccgtactcttaaggtcgggtgctaaggtcttcatttgagcctgttccttagcctgcaagtcaccaactggaatacttgtcttttcttcgacaatttgttccatgtccttgactgttacagtggcagtatcgttattaggctggtctgaactttcatcgggcttagctttttctaacttagcaacttgatcgcgatagtaggcggctttttcgtagtcttccttcttcaaggcgtcctgtttctgcttttctgcctcgtcgatcttttcttgaatcgtctttggatcgaccgtcttcaacgtcaagttcttacgtgaaccagcttcatcgagtaaatcgatggccttatcaggtaagaaacgatcttgaatgtaacgatttgacaacttgacggctgccacaatggcatcttgatcgtacttaacgtgatgatagtcttcgtacttcttctgaataccttcgagaatcttgatagattcttccacgctcggttcgttgaccgtgaccggttggaaccggcgggcgagggcggcatccttttcgatgtcgcggtattcgtttaatgtcgtggccccaactaattggaaatcaccacgggcaagggcgggtttcaggacgttcccagcatccataccaccttcagcattaccggcacccatgatttcatggatttcgtcaatgaagaggatgatattcggattgctttgaacttccttcattaattgttgcattcgttgttcaaattgacctcgaataccggtaccttgaacaagggaagccacgtccaaacgaataatttctttatctaacagtttttgtggaacttgaccagaaacgattttctgtgctagtccttccacgaccgccgttttaccaaccccagcttcaccaattaaaacggggttattcttggtccggcgattcaaaatctcgataacccgattaatttcggtatcgcgaccaatcactggatcgattttgccctgtttagcttgcgctgttaagttgaagccgtattggccaaggaggccaccgccgttgttattgccacgacgattgccgccattaggaccagctggctgggtcggtggggtctgttgttgccggtaagcgttattaggatcaacgccaccctgcattgcacggaaaatgtcgtcaagaccaccaaaaccgaatggatcttgtgccatatcagcacctccaactccgttatttggttgctgttcctgattctttagcagttgatagcaattttgacaaaggttgatttgtcgccgctgaccgttgacgctcgtatataaatggatcgtcgcttcgttcttatggcaattgtcacaaagcattatgctgtcacacacctttcgcatcagaaatataactaaatcgattaggatcatagttaaaggttcatcggctctttgacctttgttgacctttgactattagtatagcgaatttacggactgttgcaagtgaaaagcctcagggtcaaaactggacgtgcggccgggataattcgcaatggctgattgattcaattatttctgaatagtctggatagtcgcaactcatagcttgtcatgtaaccggattcgttgtatattaattacctggttaggataagtgatgatgtaactgtctgtctatattatagtacaaagcggtttttttgcatgtatcgagcctgaccagttttgatgcttgcagcgcatcgtttttcattggtgaccgtcaacagccagtgagcggcggagaactttgttcgtaaatatcaaaataatgatgcagtaatgtgtcaacctaactttgaggaggcggtaattgtttggcaacggattatacccagttaatggaagcgttgcgtcatggcgaacgcgacagttttaccgtaacgccggatgaatttatggcttttcacgatgcctatatgaagtatgagtatcgtaaacgagtcattggtacggcagacttagatggccgcattgtttaccatttcgagaaggatggtaagacaaccaattaataggcctagcttgaatgaaagggcttgtattttaattggataattgctatcatcattattaagggctcttgagtatacgtgttggcggcaactcgaattgactcggaaccaattttaaatttatttatcttgaaggagatcgaatagttatggaaaagaaagaatttcacgttatcgcagacactggtatccacgcacgtcccgcaactttattggtacaatcagcaagtaagttcaactcagaaattacgttgcaataccaagacaagtccgttaacttaaagtccatcatgggtgttatgtcactcggtgttggtaaagacgctgacgttaccatttctgctgaaggtgccgacgaagccgacgctatcgcagctttaactgaaacgatgaagaaagaaggattatctgaataatggctgaaaaggtactaaaaggaattgcggccagtgatggtgttgcaattgctaaggcctatatgctagttgatccagatttatcattcgaaaagacaacagtttccgatacggatgctgaagttgcacggttacatgacgctttcgatgcttccaaggctgaactaaaggtcattaaagacaaagcggttgaaaacttgggtgaagaagaagcagaagtttttgaagctcatatcaccattttgtctgacccagaaatgctcggacaaattgaaggtaagatcaaggatgataaagtcaatgctgaagaagctttgaaggaagttactgatactttcatttcaatgtttgaagcgatgacggataatgcatatatgcaagaacgagccggtgatattcgcgacgtaacgaagcgggtcttaagccacttgttaggggtaaccttaccaagtccagctttaattgactccgaagtaatcgtggttgcccacgatttaacacctagtgatacagctcaacttgatcgtaagtatgttaagggcttcattactgacattggtggtcggactagtcattcagccatcatgtcacggacgcttgaaattccagcggtcgttggatctgaatctgccacgactgatatcaaagaaggcgatacggtcgtcttagatggtatcaacggtgacgctttagtagccccaacggatgctgaagttgctgattaccaacaaaaggctaaagactttgttgcgcaaaaggctgaatgggctaagttgaagaacgaggccaccgtttctaaggacggcaagcactttgaattagcttctaacatcgggacacctgacgatatggatggggttttggatgctggctctgaagccattggattattccgttcagaattcttgtacatgaacagttcagaattacctgacgaagatacccaatttgaagcttacaagaaggttgtcgaagggatgaacggcaaacccgttattgttcggaccatggatatcggtggtgacaaggaattaccttacttgccattacctgatgaaatgaacccattcttgggttatcgggctattcggatttccctcgatcgtgatgacatcttccggacccagttacgtgcgttattacgtgcgtcacattacggtcaattacggattatgttcccaatgattgcaacgcttgacgaattccgtaaagccaaagctatctttgaggaagaaaaagccaagttggttgcagctggtacgcctgttgctgacgacatcaagcttggtatcatgattgaaatcccagcggcagctattttagctgaccagtttgctaaggaagtcgacttctttagtattgggactaacgacttgattcaatactcatttgctgctgatcgtggtaacgaacaagtgtcatacttgtatcaaccatacaacccatcgttattgcgtttgatcaagcatgttattgacgctgctcacgcgaacggccgcttcacgggtatgtgtggtgaagttgctggggatcagattgcggtgccattattgatgggcttaggtttggatgaattctcaatgagttcaacttccgtgcttaagacacgttcattaatgaagaaacttgatactaaggaaatggctaaattagctgataaggcacttaacgagtgtgttactaacgaagaagtcaaagaattagttgaaaagaacgtcttcggtaaataaacaatcaaactaagagcaaatctgcggatttgctctttttttgtgggtaaatgcgggtcattaaccagttggtactagccccgggtttagcacgacgggggagtggactacccgcaccggtatgatgagagctggcacagtacatgacgcgaattgactggacatttaggcattgtgacaattgtccatagttgcgaccgcgcgctagtcaatgatggacacggggcacattgctactcgctgttgacggtgaagagttggtgtagtggaaacgatgtaatggcggtgttgagtgatgcctagcgattacaattcatcatttcgaattcattttctataggtgtagctggtcagatagattttgtcatgaactcttaatttatattaagattatttgcaactcggatatttaaccaatataatgtttataatataggcattaagtcgaattcgtgatgatcatgaaataatgatctaagcgcggttaagcaacatcgattagcagcacggttaattgatggaaataaggggagaatctacgtgaatatcgggatatttacagacacatactatccacaagtgagtggggtcgcaacgtcaattaaggtgttacgcaatcaactcgaacgggctggtcatcaagtctatatctttacgaccacggatccccatgttgataagaatatttatgaacgcaatatttttcggtttacgagtattccatttgtttcgttcacggatcggcgcatcgccgttcgcgggctttttaaggcttaccaggttgctaaggatcttggcctggatattgttcatacgcagacagaattctccatggggatgattggtaagtttgttgccaaacagttaaaagtcccatgtatccatacgtaccacacgatgtatgaggattatctacattatattgcgaatggtaagttgttaaagccataccacgttaaggaggccacacgggcgtattgttatcatctgaacgggattgtagcaccgagtgagcgggttgcaaatacactgacgggctacggcgttaaagcgccaattcgcattattccgactggaatcgacattaatcagtacgagcagcagtcgacggtggattatcggcaaagactcggctatcagtctgatacgccagtattactttccttgagtcgtttggcctacgagaaaaacattcacgaagtcattgcagccctaccggcgatcttagaacaggtgccgaatgcccaactcctgattgtaggtgatggtccggcacgtgaaacactggaaaatcaggttcaagacgccggcttaacggcgcacgtacaatttaccggtgaaattgataatgatgaagtttataactattaccagatggctgacctgttcgtttcggcttcgaactcagaatcacaggggctgacgtacattgaagcaatggctgcgggccttaaaacggtagtggctgctagtccgtacacggatcaattacttgatgatccgtcactggggacgacctttacaagtgagaccgatctgatcaaggatgttgtgcgttatttacaacatcccaatacttttaacgatcccaagccacggcagaagaagctttaccaaatttccgcagagtatttcggcaagcaagtgatcaactactatcaagacgtacagctggcgtattctgaatcagcggataaatcggcgaatattagtaattaacgtgtgtcaaatcgtcaatgagcaccgccaaaccggggatgcttattcgacgtatgacgcgtaaggggacgaattatgttagacattaccatgttttcaaaagctgactccgtcaagggtcagggagtcggcagcgcctatctagaattgatgcggttgttgcggacccattggcaggatgaatttaatattaaagtcaatcgatatgggcgctccgccgtttcacattaccatacggttaatccaatgttttacctgtctacgtttatgcctaatcgaggccgtaaaatcggttacgtgcatttcttaccagagacgctcgagggtagcttgaagttgccacgaccattccaaatgattttcaatcgttatttaatctcattttataagcggatggaccacattgtggtggtgaacccgactttcattccaaaattggaagcataccatatcaaaagagcagatgtaacgtatattccgaattttgtcagcaaacgtgaattttacgaaatgactaaggctaaacagttgcgcttgcgccaacaatacggctatgatcaaaataaattcatgattatcgggaccggtcagattcaggatcggaaaggtgttcctgattttattacgcttgcaaagcagaatccagatatccagtttgtatgggccggcgggttctcgtttggccgaattatggatggttatcaggagttgaagcaggtggtggataacccgccagctaatctgtcgtttccaggcatcgttcctcgtgagaaattggtggactattataatatggcggatcttttcttactgccttcttataatgagttatttccgatgtccgtgttggaagccttcagttgtgggacaccagtattgctccgggatttagatttgtaccgggcaatcattgatggctactatcaagcagccagtgatgttgatgatatgcaacgacagatcgaccagttacgccataatccagccgggttgcaattcttgcatgacaaggcggttttggctgctcaggattattcggaagagcgccttgccaaagtttggcatgatttttatttgcaacaggcaaaagaggggtagtcaatgacaagaaaaaatatctggtcattactcgtaatggttgcgttaggcgtcggcatttcgtggtactcactgcgcaatgtcaaactaagcaatctaatggacgatattctcactttgaattggtggtggttattagttgcgttagggtgtgtcggactatacttcggtctggaagccgtggtggtgcaaaagtttgtcaggcaccgttatcggaactatcgctttaagagtgccctgcgcgttcctttagccgagcaactattcaacggtatcaccccgttttcttcgggtggccaacctgcccaaatcttcgtgatggcacaatcagggattgacgctgggcgggcaagttcagttgcattgatgaagtttgttgtttttcaggccatggtggtattgaatttcttattcgccatgttaattggttttcattacttagctgaaaagttaagttacctgtcactatacgttttgttaggttttctgattcactttgcggtgattgttggtctgttgctggtgatgtactggtataactttacaaaacgagcggtgaagatcgtcttgatcccggtcagctggtttatgaaagctgagcgatttgccaagtttgaaaacaatattagtgaaaaaatcgattcgttctacgaagaaagcgttcgaatgaccaaggactggcggatgctggtcgaagtttgtatcgtcaccttcttacagctactgttttactacctgattccgtattttattatgcgggcaatgggaatcgatgatgttaatttgattatggtgactagtttgaacgtgttgatcttcttagtgacatcactattcccgattccaggtggggccggtggtgctgaatttggtttcacggcgttgtttgctaagttcattcccagccacagtaagctgattttagcgatgctgatctggcggatcttaacgtattatttaggactattcttagggatgatcgccatggcgatgcggcctgaaaaagcagaagaaattccgattgcggcacctagccggtcggattcacaagaacagtaattttaatgggccgacatcattgttcgacccatttttcgcggttacgaattaaaggaaggtactatgttaaagttaatcaaacaacggttggtatggggactagtgttgacagcgacagtcagcggggtgttgagctgcaatgtagcggcacacgcgaccagtagtaaggcggatgaggtcaaagccgcctacgtgatggatgccaagtctggtcaggtcgtttatgcgcagaatgccgatcagaaattaccaattgcgtccttgagtaagctcatgacgctgtatttagttgaacgggccatcgagcatggtcaaatcaagtggacggatgcagtcccaattcgcaaaaatgtccgcaagatggcaaccagtgcaactttatccgtaatgccgatgcctgccaaggagacgtttacggttagggagttattcgcagctaccttggtagggtcttcgaatagtggtgccattgcgctgggggagtatgttgctggcagtaatgataagttcattaaattaatgaatcaacaagcggccaaatggcatttggatgcgagttttattagcgcttcgggacttgataatactgatttaaaaaattacgatttaaaaatcaagggaaccagcgatcaggaccaaaatctggtgtcagcaagggctgtgacgaccattgcacaacatttgattgatgcttaccccgatgttattcaagttgctaatcaacgttcagtcaaaattcataagtatacggtcccaacttcggtggagatcctgaagggcgccgagtactatgatccccgcgtgccagtcgatggactgaagaccggttatacgaatcaggccggtgcttgcttagtcgctacataccggcagaacggccaccggatgattgcaacaacacttggcggtgcgtggcagtttacggcgaacaacaacttgcggctgatgctcaaaacgaccgagcagtataaacaggttgtacctaagagcatcaattatcagattccggggacgcagaccaaagtgcgtctggtgacgaagtacaattcaaaactgtgggtgaatagtaagcagccaatgacgcagaccaaaattgctttgtggccattacatcggacagcgccaaattatctggctgctaatacggccgttcttaaattgcgattgacggatccattgtcaggaacgacgaaggaagtcatttatcggacgcctgaagcgctgacgatgcttggaccacttcaatgggcaacagcgcccgcaaaacggaccaccacgggcacgtatgcgttcgcaaagtgatgctcgcttaatagatcgtgtgatgctgaagacaaataaaggtgcgccaactatcgtaatttacgagtagttggcgcacctttttgagttgaatccaattcagtcattgaaatgactaacagtgatgaactaggacagttagctggtggactgtcgttgcttagttgatacggttagcaggttcctgcatatatgcagtgaggcgatccatggcctggtggagcttttccatgctagcagcgtaacttagacgcacgtagccttccccctcggcaccaaaaccagtccctggaataatcgcgagctgattcttgcgggctaagtctttacagaatgccatcgagtcttgttcaaagccagctggaattttcgcgaagatataaaaggctccggtaggacgtgcgattttgaaaccgagcttcgacatcgtttgataaacgaaatcacgccgagcttgatattcttgccgcattggttgcgcatcatcgattccgttggtgagggcttcaacaccggccttctgagcaatcgtggttgctgcagtgacgtagtattggtggacttttttaagttgggccgtcatttccttagaggcaaacaggaagccgattcgccagccagtcatagcatgagacttcgataagccattgatcaggatcacttcgtcaggaatgaatttagcaattgagacgtggtcgctaccgtaagtcagttcactgtaaatttcatcggatacgacccacaagttatggcgacggaaacagtcggcgagccctttgatttcatcttcaacataggtgacaccagtggggttattcgggtagtttaacacgattcccttgaagttctcgtcaggatgagcagcaataaaatcgtcgaccatcttaggcgtaatgacaaaatcgttaacacctgtatccatgaagaggggcttggcatgtgcttcttgaatgatggggatgtacgctggaaagattggggacggaatgataatggcgtcaccaggattacagatcgtcgttaatgcagttgcgatagcttcagtcgctcccacggtcactaagacttggtcttcagcatcatagtggacgccgtactttgtctcttgaaagtgggcggccgcttggcgtagctccaacagacctgccatgccagtatagtgggagtagttgtcatcaatcgcctttttagcagccgctttaacgtgctcaggcgtgttgaaatcgggttcaccgagcgttaacttgaccatatcaggtatcgcactaacttcttcgtcaaactggcggatggttgaaacttgaatgtgactgatggtttcattgagatcgtctctaaatagtgtcatatatccgaactcctttaatttataagttgttctaattttagcacaacttctcaccgtcttagcaggaagttagggtataattataagtgtgaaaatttgtggtaaaaatgggctttctactaaaaaaacgtgttattagtcctattttttgctagaatgtaaacaaaacttgaaggagcgagattagtataatggataaatctgaactatcagcaattctcaaacgactagaagccatgcgcacaactgaagcaaccgaagtgcaatcacggcggttcgaaaaggaaggcgttcaacgtgggcaagtagcgtatgatcccgctacctcgacgtacacgttacaagaattcaatccagaccaaacgtttgaatttgataacattgacctcgtggcaattgaattatacgatttgctaacggataactagattcccccaaaatccagatagattttcgatagatccatattatgacgcgttgtaatgttgaagaatttttgaagaaatcttcaagatattgctaactagtacgcaaccgttataatatggatttgttaatagcaataacggaggaagaaattaccatgcctaaatttataaaaaacacggttggaaaggtcaacacaacgttgggcttttacctcctaaccgtggtcttattttggctaaagacatatatcgcttataagagcgagtttactttaggggttaagggacccgttcaggaatttatcttgttcttgaatccatttccgacagcgatcgtgctgctcggtattgccctatatttccgtggtcgcttaaagtattggattatgatgatcattgacgccctacagacgacgtggttatttgccaatatcttgtattaccgggaattctctgatttcatgtcggcgggggtaattaagagttccggtgctgctagtaataacctcggaaagagtttgggacagatcattcatggaaccgacttcctagtttatgcagatgtcgtgttgctgattctgttattagccttcaaggtcattcggatcgatccacggcctttcaaaattcggtatgctgcaacactgaccatgattggggtggcgttgtttgctgttgacctcggcatgtctgaacatgaccgttcagatttattgacgcggacttttgataacaactacatcgttaagtacttgggactcaacacatatgcagggtatagcttctatcagaccgaaaaggaaagtgcgacgcgcgcccaagcaagtagtagtgatatgaagagtgtgctagcctacctcaagaaaaaccaggctggcgagaacgtcaaatactttggtaaagcgaagggcaagaacgtcttcgtgattcatttggaaagtttccagcaatttttaattgattataaggtcgatggtaaggaagttaccccgaacctgaacaagttctatcatgataagagtactttgagttttgataatttctaccatcaagtggcgcaagggaagacctctgatgctgaaatgatgatggaaaactccttgtttggtttaccaaccgggtcagcgatgacgcagtatgggacgtcgaatacgttccaggcagcgccagcaatcctgtcacaaaagggctatacgactgcggctttccacggtgatgtggctagtttctggaatcgggataacgcgtataagtcgtgggggtataactacttcttctactcttcttactataaagagaagtcagactacaatattggttatggcttgaaggataaaatcttcttcaaagactctgttaagtatttggagcaattaccacaaccattctacgcaaagctgattacgttgacgaaccactatccatacgaattggataagaagaaccagtcgatcgataagacgacgaccggggattcaaccgttgatggctacgttcaaacggcccattatcttgatcaagcctttgccgaattcattagttacttgaagaaggccggcttatataagaatagtatgattgtgctttatggagatcattatgggatttcaaacaaccataaggctgccattgcacagttattgggtaaaaagtcggtaacgagtttcgacttggctcaattccagaaagtaccatttatgattcattctgaaggaatcaagggtggtattaaccacacgtatggtggtgaaattgatgcgttgccaacgatttttgacctgttagggatcaagaacaagggttacatccagttcggaacggacttactgtcgaaacagcataaccagacagtggctttccggaacggggattttgtctcaccgacatatacgaagatcagtgggacagtctatgattcgaagaccggtaagaagctaacggatatgacgacgaagcagaaggatactgtcaaacagatgcaaaatcatgtgacgacggaactctcactctctgatcgggtcatccagggtgacttactacggttctacacgcctaagggctttaagaaggtcaataagtcggactatagttataagctgactaagaccctcaaatcattgaaagagatccaagctgagaagaagacgagtgttctctcgaagcataagggcaaatcaacggagagtctgtataagacggatgcaccagaactgtctagctcaagtgacagtagtagtagttcaagcagtagttctgattaatcgaactcgtatcaactaagggataacgctgacggcgttatccctttttggttgcggaaataagctgccacttgttttgaccacagcgcggtacactattattaagccgattgttgcgcagtgtgaattgacactgatggtgaacgatgaagtattaccaattttggagtcccaagtaaatgcaaagttggaatggtaggcgcgtcgcggatgttgtgaaccgataaagtacggtgatgaggtggggaatgctgactgattggttgtcttgatttggtagattgtcagcgaaataatattcattatgctagcgttggtttactttgaaaaacagtcgttgaaaattaaagggagatttattgaacttttgcttgctatcttaataaaaaccccgtaaaataaagtctattgcgacattaatcggtgtttaaaacttttctgaaattaattcataaaaagggttgacccgggtcgttattcttggtattatatttcttgtcgttaagagcgatatgcaacattactcattattatgaatattcaaattgatgtgagcatttacattgaatagttattcaaaataatttataaaaagatgttgacagcttgttctgatgatgataaactttaatagttgcgttgaggtaatcaacnnnnnnnnnnttcgagcccgcctgtcggagttatctacggtaagccatggagagttgtccgagtggctgaaggagcagcattggaaatgctgtaaacgggttatacctgtttcaagggttcgaatcccttactctccgttagttagatataataaatatgaccccttggtcaagtggtttaagacactgccctttcacggcagtaacatgggttcgaatcccgtaggggtcattatggaggattagctcagttgggagagcgtctgccttacaagcagagggtcacaggttcgagccctgtatcctccatctgatgagagttactcatcaataatttaatagactccatcatgaagaatgatatggctcggtagctcagtcggtagagcaatggattgaagctccatgtgtcggcggttcgattccgtcccgcgccatttatggaggggtagcgaagtctggctaaacgcggcggactgtaaatccgctccttcgggttcggtggttcgaatccactcccctccattctttatagggatatagtttaatggtagaacaacggtctccaaaaccgtcggtgtgggttcaactcctactatccctgccatgatggcggtagtggcgaagtggttaacgcaccggattgtggctccggcacgcgtgggttcgattcccacctaccgccctttgattgggttatagccaagtggtaaggcaatggactttgactccatcatgcgctggttcgaatccagctaacccagttgggtttgggcaataaatgatggcggtatagccaagtggtaaggcagaggtctgcaaaaccttcatcaccggttcaaatccggttaccgcctttcctgaaaaggttataatcctgatcagatttatgttccatctagttattattttgccggcgtggcggaattggcagacgcgctggactcaaaatccagttcccgttgagggagtatcggttcgaccccgatcgccggtactaagaggttttcaggaagctctaagtacctttaagaagtcgttatatcgttgatataacggcttttttgtattcttagaatcatgcgaaaataggcaaaatgatttttgggtgaactttccaattgcaaagaataaatttacaatattagcattgcatgaatatgaacgtagaaatagtctcgtaagcatcgaaaagccctgtattagcataaatcatgctaacatagggcttttcatattatggtaggtctttaaaacgaatccatccatctaaaacttgctcgttgcactcggtgataactgaagtagttggtttaagtccatggtgcttgttctgctttgtgactcgctagtgagttgtaatgtgtttctgaaccgcagctagtcaaataatggtaacggtgccaaaaaatcgatatctgttcgttcgctggcggcgccttctgctaaaattgccatctgcttgaccacttgggcgccagcttggtgtaggagggcgttggcagctgtcaacgagcccccactgctaatgacgtcgtcgataatgataacgcgcttatgattgattagtgcggcgtcagtaccatctaaaactagctgttgtggggtgctggtcgtaattgcgcttaccggttcgataagcgggtgctgcatgtaatccttacgattcttacgtaaaacgataaagcgagggtggtttgtggcctggcttagtgcctgggctagcggaatgcccttactttccatcgtgactaaataatcaaatttagtggtagttagccgttgactgagctgacgggcagcatagtcggtcagctcagcgtcgcccaatagaacgaaagaggcgatgctagtcgtggcatttaatcgaatcaatggtaactgccgtgtcagcgatcctaatgttaactgataagtttgcatatttataaccccaatccaattaatggtaaaccaaattttaggagtgccccggtcattagccccgcgaatggatcgacaagggcggtcacgacgagcgttacgcctgcaaccgtacttaacgagccgtgcaaagcggtggttgcattttccgggaaaatgacaatggtccctaagataaacaaaaaaccggcgattgcagtgctaggcacaacttttcccagctttggcagccatcccagtaatagaatcagcatcatgatcaacatcattaggatacccgcgattactggttcaggcgcgctggctgtcgcggaaataatcgtttctactggcgcaccacccagaaggctagttcccaggtctgctaatgcctgactactagtcagtagatttagattgaccgggttggggtgttgtcccgtcatttggccagtaattaagccgtacgagaggttagcaccgatattaagacaagctagactcagagcacctcgcaggattttaaaactgaactgtggcctgacaaattgtaatttgcgggtcgtcacatgttccggtagtgcgacgcgataatgtgtcgtcgctgcgtaacagctggttccaatcactgaaacggcaattgtccatactaaatctttactgatcaaataagtcacacccgccaagccgattgacagccacccaaattggggttgttcgtgcgccatttgcaacgcgattttagccaacatcaggccaactcctgccatcatcgctgccataagctgattgcccagactatgaacgatgagcggcagagtaccggtcaagccaatcacgaacatcagactcgcacctaaaaagataatcgacgaccgttcgcgtaaatcgtgtcccaggtgcccgactagtgcgagggattccgcttgaaatgaaaccggtgcaactgaactagccacgccgttgattaaaccaactaatccgaatgaaaatgcagtcggaaagaccgcaaaaccgagactcatcgccataattccttgtgggatcccgtttaaaacgaccccgattgctgccaatagatccgccaaccaatgcatattaataccgccttttttgtttatacgaataatatacgactgattagggtttaaatccagcaaatttaggacaaagtcagaataatattgtttgttaactatttatagttcgtgttttcacgaatcacgattagttggcgcacgctcgcaaatggggtatacttagtgctaattagtgaaggaggggtggcaccatgccaacgattaaagattattacttgccaaagcggccaacattattattttcgttgcatccagaaccaacacaagcgattatcaatggcaccaagattctggaatatcgtcggcgtttttttgcacgtccgtttcaagcatttgtctatacaacgggggataatgggggaattcaactctttttgcgttgtgatcagggtctgcaactcgtgcctgaacaattagcgcttgtgggcgcattgttacagcatgacgcgcccacaaccaccgcggcttattttgaaggcgctaaagccggattggcgttaccgattacggcttttacaaccttacctaacattccgttggcacagttacgtcgtcagtttgaaaactttgttacgccgcggagttatgtcttcttagatcagcctgaccggcaagcacagttggattggctattaacgcaaccctgtgagtcgctaactattttggactggcgcaaacggtatgcagcactggcgactttgttacaaaaatgaagccaagcttgtcttaatcgggctgcaactagtgcgccggttataagaatcaaacagccactcgttgtgtatttgctgagcaaaaggacttagctgtgacaactgccgcaaacgagtagtcatttagcatgactgattggatttgatcgtaaaaaaagaacctgccacaagtggtcaggttctcagattaattagagcattttttcatagacgtagcaaacgtcatcgacatggtatacaccgaccatttcgccaactcgcttgaagttcatctttgcaatcagatgttgcatcgcttgattgtcggcatgagtatcgatacggatgctcttgatttcaggatgatccgcagcaatatgagcaatgattttttcgaataattgagtggcataaccatgacctgcatggctagaatgaatcgcgactcggtgaatcacgacgtaaggtgccgtggtatttaaccattcggccttcgcagtatcgtaagtttcgtctggtgaaggcacgacagcgacagcgccgaccgttgcgttgtcgtcggcattgaataagtatgctgatccttgcatgatgtcggccgtgatttgtttgcgagacgggtagtcgccttgccactggttgaccccagcttcagcaagttgattacggccgtcactcagaatgtcgatgatcgtatcgagatcatcgagggtcgcttttttaaagtacataattctagctcctctcttgaacagcgattgactgccgaagcagtaatcgacttttaaaagtatacagaatttttagaaaaatgaaactattttctaccgattcttaggagattttcagtgacgattttcaagtaaaatcttgcgcgcttctcgggccatgtcatgttgcgtattataagcagcgaccgcactcggtgcatattggtaagtattagtctgcaaagtttgttcatagaattcgaagtagggtaagtgggtattttgcgcaatcgtgatagcacgctgccactcgaaatctacggcgcggtaatcagcatgctggaggccagtctcatcaattgtcagaagcaagtagtttgctcgtggttggcgttaggtggggattaatggcagtcggaagaccaactgtcccggcgtttagaatcaactgtcccgtggttgcgtagcgcatgatgggctggtgcgtgtgcgcgtagatgacgatatcgacatcgccttcagcggcttggtcaaagttggcctgactggcagttggtgcgagcgcgtgtccactagcgacggtcggtaaaacgtgttggagacggatggttaacgggccgacgtgtttgatgactgtcattggtaagttcagtaaccgttcaaagtgtgtcgaactcagctggcgccgatcaaaagcggtgagaaccgttgccataatttgtttgggtttagtaaacgtgttgggattggctgccattactttttggtagttttcctcgtgatttccgagaacgtaggcggtggggtgaacgcggtctagtaaggtgagacagcgctccgattctggcccgcaaacggtcatgtcgcctactgtccagtattcgtcaacgtgttgtttctgggcgtctgctaagactgcttcgagtgcagtagcgttaccgtgaacgtcagataggactgcaatttttaccatgttgagatgcttcctttctactatgtaatctaaactctggtgagatgttttattctggtaaacgtgggttttaaaaatttatgaatgtaaccactatgaaaagccatcgtaacttttatctgttataatgagtatgaaacgaagtaatatatagcacgtatattcaagccaattcgtttcgtgccgtggttatccttgcgataatcacggtttttattttaccatagtgccttatgattagtttggttggtgtcatttaattgtatcagtacatggaatgcgggtgggttaccacacatgtaattgcccagagttcaaggtgacttacatatggtgtgatattgtttaaactgaatggattgcttctaaatatagtggttaaactaattgtttgtgaaagaggttttggataaatgatgacaccttacaaaaaagttaacgtaacggatgcgcctcgactaaagctggcaattaatttgactagtgtcttgttgtcttttcaatgttatttagtaatatgattcgagccagcaccattgatattgggcatgtagcttggctaaaatggtcattttagcaattgggactgttgcgattcatgggtgcgggttgtactggggaatttttacctagcatagcaactagtgataacgttgcgatactgtctgatagaagatacattgcgggggatgactatttatcgctaaaaattgggaaattagtatccacgataattgagttggagtatcaaaaggccatcaacctgcgtatatgcttcgcggttgacggcctttagtttagtgctgaagtcaaagtagctatgtgaatggatctcatctcaaaacaagctatacaccaaataaatattcaacacagtaataattccggccagtccatatcccacccacgttaccgccgggcaattaacgtgggccttcatcaggccggcgtcatttgtcaacgcaactagtggcaacaaggtaaaggggagggcgatgctgagtgccacttgcgcgtagatgatcaggttttcaaaggcagtgtcgctaaagccgactagcataccaataatcagaatcggaattagcgtgacggcacgagtgagtagccgacgttgccagagcggcaagcggatgtgtaaataaccttccatgacgatctgaccagctaaggtgctggtgatggatgaaattaggccggtaattagtagggctaatgcgaataaccagctcatgaccgggctagcaagggcgccaaccacggtggtactttttaacccatcgaagacggcctgcagactcgctaacgcgttggtgtgaccgaagaaaagcgtcccaccaaggacgagcaaaagtgcattgatgagaaaagccgcaatcaagtgcactgttgagtcccaattggcgaagcgcagtgcttctgtgacttgggctgggttatgataatcataacgccggctttgtgcaagcgatgagtgtaagtataagttatgtggcatgatggttgcacccaagattccgagactgaggactagtgcggtatgatttttgacgatcaatggtgttggaactaagccgagcaacacgttgccaaattgaacgtgggcccgtcccacctcgataccaaaaataatgccgacggtcaaaatagcgacgaggacgattacttcgacacgccgaatgccaaatctcaaaaacaacaagacaactaagacgtccgcaatcgtcagtaaaattcctgcaagtagtggtaagccgaataacatttttaaggcgattgcggttccaattacgcccgtcatatcagtcgccatcatcgcgacttcgtttaaaatccacgcggcgtaacgcacgggccggggcagcttgctagcgatggcttgtgctaagtcttgccgggctacaacgcctagcctgattgccaggccttgcatgaacatggcgacaatgatggctaatgcgagcacggctaaaagccggtactgaaactgaccgccaccggctagggatgtcaaccagttgccgggatccatatagccgactgccactagtgcaccgggaccgctataggctaaaaatttgcgccaaaaggccgtctgatgaacgtcgggaaccgcgacgctctgattgatttcttcaagactttgatgacgatgtgattgcatggttcgacgcctcctgcttttggatagcgaggtcagccagaaattggctgaagccggtatccttattcatcggtggtactaagtcaaaccgatcaccaccgcttgcccgaaaggtttgataattttgaacgtagtcttcctcgagggtttccaagcagtccacgacaaaggatggcgtaactactaatacgttgcgtttgccaagttcgaccaactgcatgagctcattttttaagtaaggcttcaaccacggcatcggtccgaacttggactgatacgccgtaatgaccttatcagctggtaattctggtcgctccgccaacacagctttggtcgtggcctcgcattcgcgttgatagggatcaccatggcggaccattgcagtggggatgctgtggtagctgaagatgaccgcatcataatgatgcgcctgatagctttgccagactttggttgctagtaagtgaatgtaggtcggttggtcgtagaaactgtcgataaaggtgtgtggtaatccagttgcttcaacttgacgatggatgccgccgtgcgtgctctgggtgtattgcggaaaaagtggtaaaataattggcttttcacacccatcagcaaccatggctttcaaggtcgcaccgatatcgggttgaccgtacgtcattgctagtcggacgtcccaatcgggtaatgctgcttgtacttgttggcagatggcttgactgtagacgattaatggtgagccttgtgggagccaactatcctgataaaaggtggccgaacgccaagaacgggtcggtaagataataccacgcaacagcggttgccagagtgcggctggcatctcgatgacgcttggatcacttaagaattcttgtaagtatgctttgacatccttagtccgtggggatgccggggagcctaaattgacgagtaataatcctgggtgcatagaaacccctccaatgctcttgataaattaatcatagcataatcgtcagcttgtatacggggttaatggtttatttattcgattatctagtgataatcaatttactgctgaaataaataaaatctcttgctagcaactggccgggctagcaagagatctgaaattgatatttggttttgttgcagttcaaaaatcggtgtcgtcggctggatcgtactttataaagtacgattcagaaatgccagcaaaaaccatgaccatgttcgttttcaggtcgtcagcatcaaaagacgattgctgggtggacttggtgagttgagctgactaacgggcttactttgcggcgtgggtccgtcgataacgttgattgagatagtagcctagatagcaaatcgccacgaagggaatggtgtaatacaaggcaatccgctggttagggtcaaaccaaatcaagatacaagagagcccacttaagataaaggccagccacgggacgaccgggtagccgggcgttttaaaggtcaattgatcaagcgactgcccacttttcaggtaggctttgcggaagttgatctccgaaagggcaattgccatccaaacaatgacgacggcaagtcctgaaatggatactaagaccaggtacaccgaaccggcggcatagacactcgacaatagggccagaatgccacccagcatgctagtaattagggcgactaacggcacatcgcgcttcgtggttcgtttgaaaacctttggaatggttccctcgttcgcaagtgaccacagcatgcgggtagacgcgtagagaccagaattagcggccgacataatggcggtcaatacgacgaaattcattaaatcagcggcgtagggaatcccaatcgctttgaagacgagcacgaatggactttgcgtcacacccgcttgtttgtaaggaatcagtgcggccatgacgaacatgctaccgatgaagaaaataatcagacgccagagggtcgttttgattgcggtcggaatggtgtgggccggatccttagtctcaccagctgtaattccaattaactcagttccagaaaaggcaaagttgaccgttagcatagtcgtaaagacgccaccaaaaccattgggaaaccaaccgttacgcgtatagttgctcagaaacggggcactggtatgaccgtgaagtggcaggataccgaccattgccagtccacctaacacaataaaagcaatgatcgcgatgactttgatactggcaaaccagaattccgcttccgcaaaccagcgtacggagagggcgttaacggtgaagatgaccaccataaagacgaggctccagatccaggttgcaatgtgcggaaaccacgtttgcatgatgagccccgctgctgtaaattctgaaccgagggcaatcgtccaagtcaaccaatataggatggcaaccgtaaagcctgtgccaggaccaatatattttttcgcatagacgtgaaacgccccggtgtagggcattgcaactgacagctcacctagacagagcatgacgagatagacgaggatggccccaatggtataggcgagcagggtcccaattggccccgcttgatgaatcgtgtaaccggaacttaaaaataatccggtcccaatcacgccaccgagtgaaatcatcagcacgtgccgtgattccatctggcgactgaggtgggtttgttttgacataatgtaccggccttccttacttgcagaattaatatgattagactatgattagaaaatcaacaatgctattagaataacataatttataagtagaaaggaaggcaattattgcaatgctttcattaactgaacaattgaaccggggcccagtcgtctcggacggtgcgatggctacggaattagaaaaacggggcgtggcaaccaatagcgcactgtggtcagccacggcaatgttggaccacccggatgcgattcaagcggtccatcagagctatctggatgcgggcgcaaaaatcatgacaactaatacataccaggccaacgtccctgcatttgagcaggctggtattgctgccgcacaagcgcgtcaattgatacaacaggcggtgacaattgcgcatacggcgcgtgatgctagtcatgtcacggatgctgtgattgctggtagtattggcccgtacggtgcttacttagcggatggtagtgagtacacgggtgcatatcagttaacgccgagtgcctatcaagactttcaccgcgaacgcctggcgttgatcatggccgccggggtggacgtgcttgcattagaaacgatgccacgtttagacgaagtacaggctttggtacaactaatcacaaccacttggccgcaacaaccatactgggtaagctttagtatcaaggatccacagacattatgtgatgggacgtcattagctgtggccgcaaagtgggtggcggcccagccgaacgtggtcgctgtgggggtcaattgcactacgctggaaaacattgcaccagcgttaaccactttgaaggcggctgtagcggttccgttgatcgtttatcctaattctggtgatcaatatgatcccgtgacgaagacttggcaagcaactcatttgagtcatcaatttgcatcctttgtcccccagtggttagccgccggggcccgcattatcggcggctgttgtcgcacaacgccgaaggatattgcgacggtggcacgggctctcagtgtttcggattccgccaagctttgaaaaatgttaagaaatgacggtgttttagttcatggtgggcgtgtctcagagatctaagttgtcttggggtgttcgttacacactaattattgatttaattatatttgagcaaaacaatacctagcgtgctgagcgtcactaggtatggctagcaatttaattgaaactggtgaaaaatcactagtcgggcactgctgatacggtagttgttcacgactagcgatttttgtatgtcaataaaactgttcatatcttggtcgagtaacgtaaaatatggtagggtaaagatagtgtataggtataacagatgaagtggtcaatcgtccgtgcgtactcgaagtttttgaactcggtgacaggatgagttgatttttcagattgagaagggaacggctaggtgatgtattattttgtgggtactggtttaggattgaaattgacgggaattgaaaaggcacagttgaaccgactggcgctatttgacgccactggttatcaggctcgatgcgtctatgtcacttataatccgcgtttacatgagcatgcggcccgctttggtgcggaaggaaaatgctttagtttgtatgatttctttcaggggacgatgcctgaagcagtgactaaaatctatcatgattggatgcactattggcaagctgtttgtcactttaaggtgattcaggttccaaatacgacggattttcgcgtcctgggtaccgatggtcaatatttgatgtacgttcattttgtggacgccgggcgacaacaattggattatgtcaattattttgataatcagggtgttaaagtccgacgcgaattttatgataaccggggcttcctgagccggacaagctttttagtgaaacatcaggaagtgcacacagaagtgtattatgatttacaagggcaagtcaaaattatcaaacagtatgacattaccgggccagagccaaaactacgactgattacgttgaagaactatcaacaaagagactttttcttcaataccgaacaggcttttcagacattcttcttcaatgagttggccactgctgatgacgtctatttctgtgatcgtaaccgacaaacggcggcggccttaggtcatacgcgccccgcaattcgcgtgtgttcagtcttacatagcacgcatctacggattggtgaggacgtggtaagtgggcatttgaaatcggtctatcggtatgtcctagcccatccagaccaatttcaccgaattattgtgtcgaccgagcatcaaaagcgtgatttattggcacggtatgataatttaccaccagttgtcgtgattccagtcggctatacaacggttcatccggttaaaattgatggtcgtgacccgcaccggattattagtgtggcgcgctattcgccggaaaagcaattaccacatcaactggaagtggttcgtcggttagttggtgaatttcccgacctgactttgcagttgtttgggcatgggcaaaagattgaaatgcaaatgcgtcaatttattcaggccaatcagctagaaaaaaatatcgttattcggggtttcttgcccaatctggcagaagagtaccagcgggcaagcctcgccttaatgacgagtgtggaagagggcttttcgctagccacaatggaagctgaaagctatggcgtgccggttattggctatcgaattgcgtacgggccggaagatattatcgaagatggcgttaacgggtacttagtgacacccaatgatgttgatgagttgacaatgaaagttcgtcagtatttacagcaccctgaacgacaagcacaactgattacgaatgcctacaattcagcaactcgttacagcaagcagacgattattgaaaagtggcgccagttaatagcagcactttaagaaccggtgataggggcaaacaaggcgtctacctagtttgagagactaggtagacgccttgttgttatctagatattaataaagtaataaaatcagtaccaactgaacggctacgttgatcatgagatgtaaccgagtacggccaaaggactgttgactgaaccagacagcaatcgtgatgagaattgcaacgatcgtttgccaggtcagcggctgcaggaagatggtgataacaagtagcaggccagtgatggccgaaatcaattgattgatttggcgttgacggctgaagctcggaacgtataggaagacataactagccagcatgggggtcagcttccagagaaaagtagttgataaatagttattttgtaaatcgaagacggccactgggatcgtgaacgtcatgatgacgccgaaaacgactagaccaaagtagttttgcataccgaagcgtggaacagccatcacgagcaaccacgcactgcacgttaatagcaggtacagtagttcggattccttggcaataatgttggtaaatgcaaaggccacggtaattccaattgcaatgaggctccactggggagcgatccgccgatctaagataatgaagaccgcggcggccacggctaaggtgtagccaatcagtggtaactgcgcggctgaaaatgaggccgtttgaaatgagcgcccgtaatcgagggcggcccaccaactaatgatgctttgaacgatggtaaagatcgccaaggcgatgtaatcgcgtttaatatgtaattttccgattcgaatcatattgtcaacactctctaattaggataatgagttaatcgtaccggtcggggcagttcccgtcaataatttgacagaaatctttaaaaaaaatggtgattgtgataaccttatatagttatgagccgttcccgaaaggataagtttagcttgttcaatgaagaataagtgatgcttagatgccttgtaaccgaaattatcaagggggaatttattgtgagtgaaagacacttatttacatctgaatctgtctctgaaggtcatcctgataagattgctgaccaaatcagtgacgctatcttggacgcaatgttagcccaggatccacaagcacgggtcgctgttgaaacttcagtgacgactggattagtgctggtcttcggtgaagtttcgaccaaggcctacgttgatattcaaaaggtcgtgcgtgacacgatcaagtcgattggctatgttgatggtcaatacggctttgacggtgacaactgtgccgtccttgtctcattggatgaacaatcaccagatatcgcgcaaggggtcgatgattccttggagacgcgttctggcgatgctgacccattagatcaaatcggtgctggtgatcaagggatgatgtttggttatgccatcaacgaaacccctgaattaatgccactgccaatcgcattgagccatcggttgatgcgtaaaattgcagcgctacgtaaggatggtaccattaagtggttacgtccagatgctaaggcccaagtcacggtcgaatatgacgaagacaaccaacctaagcgaatcgacacggtggtcttgtctactcagcatgatcctgatgttgatttggacacgatccggcaaacggtcattgatcaagtcatcaaggctgtgttaccagctgatttattagatgaccaaactaagtatcttgtgaacccaactggtcgttttgttattggtggtcctcaaggggatgccggtttgactggtcggaaagtcatcgtggatacgtacggtggttttgcccatcatggtggtggtgccttttctggtaaggacgcgaccaaggttgatcgttctgcaagttacgctgctcgttacattgccaaaaacgttgtggctgccggtttagctgatcaggtcgaagtgcaattggcatatgccatcggggttgccgaaccagtttcgattgcagtggatactgccgggaccgggaaggttagtgatgaagcgttgattaacgccattcgcgaaaactttgatttacgcccagctgggattatcaaaatgctcgatttgcaacggccaatttatcggcaaactgcggcatacggccactttggtcggaccgatattgatttgccatgggaacatactgataaagtggatgctttaaaagcagcatttaaataatgcggtaacgttgattcgttacggtctgtaggtactcgacgctaaaagcgaccttttttcaaggtcgcttttttttgcgggctattttagatgcacggggttttaaaatgattgatagagaaggagaattactaagatgcaacagcgtaaaactaacgtaatggcggttacggttgccatttacgtcgcgacgtttatgagtgcgattgaagggacaatcgtgtcgaccgccttgccaacgattgttggtgatttacacggggtttcattgatgaattgggttttctcaatttatttattgactaatgcgatgatgacgccaatttatggaaagctgactgacttggtcggccgaaaaccagtgatgcaagccggactaattatttttattatcgggtctatgatgagcggtttgtctaattcgatgccggtgctaattttttggcgggccattcaggggatcggtgccggggcgctaatgccagtctcaatgacaattatcgcagatatttattcattcgaacgccgggccaaagtgctaggcttcaatagttcagcgtggggcattgcttcagtgctggcaccgctgattggtggactaattgtcgataagctcagctggcattggattttcttcattaatgtgccagttgggttgatcacccttttcctatttcaattttatttacgagaacccaaacgtcacaataacgtgaaaatcgactacttgggtagcttttggctgatgctcttcttgctgtgcttgatgctaagcttccaactattgggaaacgccactatcagttgggtggccgttgggactgcttggatcattagtgcgctcagtttgtggctatttattcgtcgtgaaagtcgcacggatgaaccagtgatttcgatggatttattcaaaaaccacacgtttattattcagaatgccgtggcggccttagtcagtggcttcctaatggccgttgaagtttatattccaacttggactcaggggatactgggtgtaccggcttctttggcgggattcgcagtgacaccgagctcgttaatgtggatcgtcgggtcattcgtgacggggcggttattggcaaagtgggcgccgcgacggattttgtatctgagtttggctttcattctcgtgacaagcatttgcttagcgtggttaccagttaatactgctttcccatggttcttcctgatcacagcgattggtggcgtgggctttggaattacaattacagcaacgaccgtcacgtcgcaacaccttgtgccagctgagaacgtgggcgtcgcaacgtccttcaatacgttgagtcgaacgattggccaaacgttgatgatttcaatctttggaattgcgttgaacgttgggatgaaccaaggtattcagcaccatgcaggaacgaacatggcgatgatgaacaagttgatcaatccacagacagcaacgcaattaccgtctcatttgttgccgacacttcatcgtatcttatatacgggcttacattgggtctacctgattggccttggtttggttattctagcctttattgtgaatagtttggatcacggaccacaaaaaacggcagcacaacacgcggctgatttaaaccaaaatcaggattagtcggcttagtatcaacatattaattgtcaaagcgactcataatttgtcgtttatttgatattgacgtaaaaagatctgaaaaattttcaataaaatttccataagtgttataaataaattttaagttgttagacgagtgtaatgagctttatgaggcctattacactcgttttcattaatattatttatttggtagattgtaaaatnnnnnnnnnnaaatttgcaatctaccatttggtaactattttaggaaaattaatggaaaacgtgtaacaagattgacggtatcaactattgccaacaaaacataatcatagtattatgagtgcatagcctaacgattgatggtgtataccaatgatgctatatatgtattttttgtatcatatataaacgggtttgattaggttagagaaggaaggcaaaaccatgaaatttctgagacataaatcttttagaggagatccgaaagttcactacaagatgtttaaagtcggccgtacttgggtatttacggcgatggcatcatttgtattgactgctgcacctcagttagtatctcatgcaaatacggtttcggcggatactagtagcgatacggcaagtagtacgtcaactagtactaccagtgactcgtctacggcatcttcttcgagtgaaactgcctcgaacagtaattccgaatcttcatcggatagttcaagcagcgatgacggtgcttcagacgcaagttctgcgagcgaaacaagtacgactaatgcgacaagtacatcaagtactagtagtagcagtgtttcaacggctagttcgagcgcatccagcgcaagttcaagtagtagttcgagctcgtcaagcgctacttcatcgagtttaactgatagcagcagttcttccgcagctagctcaagtacgacgagtttgtcaagcagtgctagcgtagcggcaagtactgtctcgacagcaagcagtgttgccagcacgactaagtctgcaagtacggcggcttcaacggcagccattgcagcttactcgtcggtatcggctgccagctcacataccgatagtaccgcagctaaggcggcttcatcatcagcttcattagctggttcatacgccacacttgccagcagctatgctagtttggtcaataacctaacgacgcaagcagcagtgagtgcggcccaaagtgcctatcaagaagcgcttaacgcggctgatttgtcacggcactacaatagtattgcaaacatgtacttagacgcattgacaaatggtgtggggtccaatgttgataatgcaatcgcatactctggtgcaaattctttagcatatagtgcagcgagtgcggccagttcatacgcagccctggcttcaacggccacctcaacggccagcagtgctgctacccaaggcttaattaatttagcaagtagcaattattccgccgcatctagtgcggcatctgcagccacggtagcagccagctcggcagctgaagcagccaacagtgcatacttagccatgcaatacgacaaaaataatacggccgttacctcagcttacaccgttgcttctagcatggcagctgcggcttcaacggccgcggttaacgcaacgaccgctgcggtggcagcttcctcagcctatgccgcggtaagtagtaatgcggcaaataatgactatgaagccactagtactgcctatgcagttacttcctccgccgcaacggaggcgcttggtcaatatgccgccgggagcaccgctactagcaccgctagttcggcagccagttttgccaatagtactgcaattagtgatttggcgagtgcggcttcttcaagtgcaaacgtggcgaatacagcaaagagtacggcttcaagtgcggccagtgtggcagcaacgcaaactggtactcaagcgtcagcttatgcttcaagtgctgcaacggccgctagctctgcttcatcagcctacgccgtcgcaagtacggctgcaaaatctgctgtcagtgctagtgatcctgccaccgcggactcatacgctcgggtggcccaatcggcatcttcattggctgctagttacgctgcaactgccgagtctaacgcgactttagctgctaagttttcgacggatgtcgctaatgaacaaactgttagttccaatgcgactttaacgacgagtacggcaacgcaaagtgtctcgactggagatactgtgacaattaccaacaaagtgggtttggactcagggtattcagtaagtggtacaccaacttaggtttggtacgtctcaacggatgggacaacttggacgaccattagtggtgcaacatcggcaacgtatacaacaactgcaactacttcagggacgtattattatcaagcagtcgtgactggtaagcgagtcacggcattagtcttcacttcagattttaaagcagctggtaatgtgattaccattgttgtcactaatccagaagggacctacactgaaattgccagcagttatgccagccaagccaacagcgcagcctcagtggcaacctctcaagccgccgctgcaagtagtgcgatcagtttggccagttcttcagctaacttgacgggctcattagctagttactacacatcacaggctaattcttcatacaacgcagctagctcatatgcgagtgtggcttcggaagcagcaagtattgcaactatggccagtacttcggccgcttcttatgaagccgaaggggcgtataccagtgctaatatctgggcaggaatggcatcgagttatgcgagtgttgcaaccgaatatgctagttctgcaagtagtgcggcatctgaggcagcagctagtctcgatactgctttgaaaaatgcggttaatgaagatggtggtgataccgctgctgattatttagcatcaagttatgccagtatggctgcgtcatcggcaaatgtggccggtgaccaagcctcgttagctgcatcctatgcggccaacgctgctaatgcatataacgttgctggttcttcatttaataccactgcaactagcagttataatgcagcggcaagttctgcagctgtagcggctagttcatacgcagcggcagctagtgaagcagcaagtcttgctgcttcatatgcagcggacgggaattataattcggctgccttgcaacaaagctacgcggctttgcgtttaacctatgccacagatcaattgaatgctgcttcgagtgcggcgagtgcgattacccaaacggtcgtgcaagcacaatccagttattataattcgattgcaacggctgcttctagcgcagcgtcagcagctgaatcggcagccgggaacgcaatcagtgtcgcgagttcattaagtgcaaagtatgcgtcaaacaccacgttgggtagctcatacgttgcacaaactaataattatgccgtgacaactctgggtgcagcggcggccgcaacttcagctgcggaaatggcagctcagtatacaagccaggattcatcggcagtagctgcgggcgattatgctatggccagctcatatgtgaccaatgcctcagcagcagctagtgaagcaacctcatatgcggcattgtctacatccaatgcggctttaggtagtacggcggctagcaacgcgacgaattattcaaacaatacgaattcatataaaagcactaatacgggtaatgcaacgacaattctagggattgttatttctggtgggatgacttctcaacccgcagcagtgacgtcgaccgtttctggtgggacctttaccttgtcagcttcgtcagcattaggactaggtggggttgcactatcatcaaaaacaacttggtatgttcaagtcaacggcacttggatgaccttagataaggccagcgcttatattgaatcatatgatgcagttgacagtgctggtttactgtcaaccagtagctcattaacagttactatcaaagcgggctatactggatcattactattccaagccgtacaagggttttcttgggacttattaaacttggctacagtttatacatttgcaagtaatttagcggaagtagatgtttatagtagcaatattccagcaacaaacatttccatagctggtgatgattacgtcattaatccaacgaacagttcgagtggctcaaacgataaggttactagccagtttacatcaacgactaaccctgagaatgctacgggaacgattacctggacgacaagtgattcaagcattgcgacaattgatgattctggccttttgaccgttgtgtctaatggaacggtgacaatcacagcaacaattacaaatgcagacggaactagctattcatcttcaaagacaattacaattggtagtggccttgaggatgcaactgttgatgcaggaagtgatttgacgtgggttccagatggctcgactacgggtactgggactaatgttacttatcaatggtattattcttcaacagcggacggtactggaacagcgctgagtggtcagactggtatgacacttaatctgtcggatctgacagtagggcaatccggttattactacctagttattactggatccaatacgactaacgggactactaccacgacaactgtaactttaggccgggcttacttgactgttaatgctgtttcaactgaagcggcagattctgcagctagcgaagcagctaactacgcaaatcaagcgacggaatatggttcagttgctagttcttatgcgaacattgcgggcgaatatgcaagtaaaaactcagaagcaagctcctacgcagaacaagcaacggcagcagcttctgatgcacagtcagctgcaacagctgcttcaactgcagcctctaatgcggcagccgcccaatcaaatgcagattctgcggaagctgccggcgaaaactcggctgcttccagttatgcagaggaagctaaaaagaaagcgtccgaagcatctgaagctaaaaagaaagcttcaagtgccgctgatgatgcaggctactatgctgatttagctgctaatgttagtgaagatgactcggatagtgattctgacggcgacagtgattcggatagcgacagcgactcagattccgactctgacagcgattctgattctgacagtgattctgactcagacagcgattctgattctgacagtgattctgactcagacagcgactcggattctgatagtgattctgattctgacagtgattcagattcggatagcgacagcgactcagattccgacagtgattcagactctgacagtgattcggattcggatagcgactcggactcggacagcgactcagactcagacagtgattcggatagcgacagtgactcggactcggacagcgattcagatagcgacagtgattcagactcggatagtgattcggattccgacagcgacagtgactccgactctgatagtgactccgactcggatagtgattcagatagcgatagcgacagcgattccgacagcgacagtgactccgactcagatagcgactcagattccgatagtgattcggattcagacagtgactcggactcagacagtgattccgactcggacagcgactcggattcggatagtgattccgactcagacagtgactcggattcggattcagacagtgactcagactctgatagtgattccgactccgacagcgattctgactcggacagcgactcggattcggatagtgactcggactcagacagtgattccgattctgacagcgattcagattccgatagtgactcggactcagacagtgattcggatagcgacagtgactcggattcggatagtgattcggacagtgattccgattcggatagtgattcagatagcgatagcgattcagactctgatagcgacagcgattcggatagtgattccgactcggatagtgattcagattcggatagtgactccgactccgacagcgattccgactccgatagcgactcagattccgatagtgattcggattccgatagtgactcagactccgacagtgactcagactccgacagtgactcagactcagacagtgattccgactcggacagcgactcagattcggatagtgattccgactccgacagcgactcggattccgatagcgattcagactcggatggcgattccgactccgacagcgactccgattcggatagtgactcggactcagacagtgattcagatagcgacagtgactccgattccgacagtgattctgactcggatagtgattcggattctgacagcgattccgactcggacagtgattcggattctgacagcgattccgattccgatagtgattcggatagcgactccgattctgacagcgactcggattcggatagtgattcagactcagacagcgactcggattcggatagtgattcagactccgacagcgactcggattccgacagtgactcagattcggatagtgattcagactcagacagtgattccgattctgacagtgattcggatagcgacagcgactcagactcggacagcgactcagattccgatagtgactcagactccgacagtgattcagactcggacagtgattcggatagcgacagcgactcagactcggacagtgactcagatagcgacagcgattccgattctgacagcgattcggattcggatagcgacagtgactcagactctgatagtgactcggactcagacagtgattccgactcagacagcgattcggactcagatagtgattcggattccgacagcgattcagatagcgacagtgattccgactcagacagtgattcagattccgacagcgattcggattcggatagtgattcagattccgactcggatagtgattcggattccgatagtgattcggacagcgacagcgattcggactcagacagtgattccgattcggacagtgattcggatagcgacagtgactcagactctgatagtgactcagactctgatagtgattcggactcagacagcgactcggattccgatagcgattccgactctgatagtgattccgactcggacagcgacnnnnnnnnnngattcggatagtgattcggactcagacagcgattcggactcggacagcgattcggatagcgacagtgattctgactcggacagcgattcggactcggacagcgattctgactcggacagcgattctgactcggacagtgattccgactctgatagtgattcggattccgacagcgactcagattctgacagtgattcggattcggatagcgattcggattccgacagtgattccgactcggatagtgattcggattccgacagtgactcagactcggacagcgattcggattccgacagtgactcggactcagatagtgattcagattccgacagtgactcggactcagatagtgattccgactcagacagcgattccgactcggatagtgattcagattccgacagtgattccgattcggacagcgactcggattccgacagtgacgctgactcagacagcgactcaggttccgacaacgactcagactctgacagtgattcgaatagcgacagtgactccgatgcaattacagattcagattcaaatgatggaaccaattctgacaatggtagtaattctggctcagatggaagttccagttcaaatactggatcaggttcgggcaatacgacgggctctactggaaataattcaggtactggcactggtacgacaacttcatcgactgcttctaacaacggtgctgcttcgacaagtacgactagcttgaatgctgcaacaacgtcagcaactgctgctacatcagtggtttatgccgctgctagtgctcaagacgttgatgcgacttctgatcagactgattcagattcgaagagtagtaatgattctgataaggataagaagtcagctgatacagatagtgctgatgataaggtcggctcaagtaatactgacgagaatggtaagactgcatctgatacaagtaataatgccggaacgattttcggtggcttgttgaccgcggctgcagctgctggactcggctggtggttcttcttgttcggtcgtcgtcgtaaagatgatgatgaagatgacgagaatcaaaaatagttaaaatttaaagctgatttgttagtactgctaacgatatacgttgtaaaataagactattaaccaaaacgggcgtgaagcccgttttggcgtacataaaagaaaattgaaagaggtaagactaagatgcaaaaatctactgtcaccaagcttaagcaagcactgattgcaactggaaatttgaaagattacggtacaagtaccgtaaccttggcactttcggtatcggatcatcgacatcgggcccaagtgcgattctatcgttgcgattctttcaagcaagcttggatagcagttgcacaacaattagccaaaacccctcaagcgagttgggttcgattagaagcagttcaatcaacacagaagttaccaagagaaacttttgaaaagcgattggcagctacttttcggatgaactattggcgatacggtattagttttgatgcagatttcaagacagccttattggagatggaaagtaatggacaagcatttttccgtcctagcaaagcgcatcgaattggtaagaatcgttcgggttcttgggtcgactatgatcgagtagagccgtatcttaacaagcgtgaaggaacgctaccagtcgatattcgaaagacagaaaatgtttgggtctttacaaccgctggtgtatttactgacgggcagaaaatctggaatctatctgagcaagaggattgtggtaagggcgttcgggtggtgactggcgagcagagcgagctgcaatcagctattgaacatggtgaaactttcctgattaatcagttgaaggataacggcaaatttgtctacggttattttccggctcgtcaaagagttcttagcaattacaatgttgtccggcatttttcgtccttatatgccttgttggaagccattccattcacaaagcgcactgaagattttgcaaaagttaagttagcgattcagtggggcttaaaaaatgccacgattgaaaaagaggacgcaatcttcgtcgacgataacggcgaattaaagttgggtgggcaggccttattgatgcttacattgtgtaaatatcaagacgtcaccaaggatgatactttcatgccagttttaatgaaagtctttaaaggcgtccatttcttccaagaaccgtctggcaagttaattcatgttctcaacccagatttaacggtcaaagcagcttttcgaattatctattatgagggagaagtcgcatttgcgctttcccggctatacgagttaacgcatgataagaatgtgatgaacctggtgaagcaaatcttggattacatggtggctaatgactacggtaaatatcatgatcactggatttcttatgcaatcaatgaagcattactggtattcccagacaatcgcgattatatgaaactgggtttgaaaaatgtattcaatcatctaaaattcattgaagagcgtgataccacgtatccaacattgcttgaattagttgatgcggccgttaaaatgaccgacatgattaaacgttcaggtaatgaagacttgatggcaccttatgacttggctcgcttacggcaagtgttgcggtaccgtgcgttgtatgagattactactgggtgttttctacctgaaattgcaatgtatctctataatccgcagaagtttattggtgggttctatgcacgtcatgacaacttccggacacggattgacgattgtgagcatttcttatccgggttagtgaactattataactacacatatcgacaagcataatactaggtaacagaaagggtgactgtatgttttacttcattaatgaatatattttaggcaagaattcgagtgttgagcacgcggcaatcaaccgggtgaaattatttaaccactataaagcgccagcccagattgtgactaagatgtatgatcgtttgctacatcagaccatgggaacttttcagttagcaaaccagcaagtgctgaatatgtttgattactttcaacaaaccacggatgtgccaactaaagttctgcatactgatgacatgcatctgccagttgaatatgcggtagaagtgggtgccaactttagcaaaatttttaatggtgatgaacacgttagcaacgtcggctttattcctggaacgattgggcgcgtcttttaccaagaattcttcgacaatcaaggtaacttatcttcaaccgacctgtgggattggcgaggcttcaagtccagtacacaatattttggtcagaacggtaaaatggttttggaacggttttataatctacaaggcgagaccgttattgagcagtactatgtacctgacactaacggtaatccgctagcgtcacgtttgattttaaagaattatcgtgatcaagcggagcgcttcttccaggacgcgaaccatttatttcatttcttcttggtcgaactcagtcatttggacaagcaaacgacgaccttcattagtgatcgcccaggtaccagtgtgaagccgttgttggaacttcaggatgattctcacaagtatgtgacggttccaatttatcaggcgaaggatattaatgacccaattcattccccgttggacgggttcttaacaccggccttcgataatttgcaacactttgatggcttcattacagctactgaaagtcaggctcagcatctgcggacgcggttccctaaagctaaggtgacagtgttaccaactgtaactacgagtccgttggcgcagagtaaactacggccaatcacggcccgccccaagcaattgctatacgttgggcggctggcgccggatcggcaactggatcagttaattcggaccattgcgttagttaagcaacaggtcagagaaattcagtgtgacttttacggctacggcgatccagagtatcttaagacgctgaataagctggttgaagaattaaaattgacgaataatgtgcatttattagattatcatcctgatttagaaacacgttatgatgattatcagctgttgctcaataccgatattgttgatggtggtccaatgagtatgccggaagccatgagtcacgggattccagtgattagttatcgctttaattatgggcctaaagattggattgaggacggtcatgacggtttcatcgttgatcctggcaatcaattggcgctgcgtgaccgggtcatcgaattaatgacggatacgaagaagttgacggctttcagtgaagccgcctttaagaagcttcatacgtcacaaactgacttaaaagtttggcaccgttggcaacaattactgggtattaagtaggagggcgcatatgtattatttcttaaacgataacatgcaattttcaaaatcaggaatcgaacaggcggaaatcaaccgactgactttattcaagaagcaccatgtggccgctaaaatcgtgacccgcgtattcgcaatgaatttgcacgatgtgcttgaaggggccaacattgccgatgctgattttgttaatctttttgacttcttttgtggtagtcagtcggtcaagcgtcaaaggtttgatttggccgactttgaagtgccagccgatgctatcaagacccggaaggataatcagattcaagtcatggaacgtggtaagttaatcatgattatttaccttcgggccggtacggaagccgttagcaatgtgcaatactttgacgttaatggtcgtacgctcaagatgagttggtgggatacgcggggctttaagtgtcttgaacaattatttgactgggacggtaagattgcccaagaagcgtactttggcccggatggattgattcacgtggagaagttacacttgttaaatcacgctggtcaggagcgaatcacgtggcgcgtcttgaactacaacgagcagagccatacttttaatgggatgaatgaactgacccgttacttctatgatgaacttaaccagttgaatgatgaacaaaatgttttcatttgtgatcggaccgtcgaatgtgcctggggcttattcaatatgaccacaccagctaagaaagtcttgcatctacataataaccatgtgagtgatgctaaggatattatgcattctaccttgaacaataattatgctaatgcgctgaataattgggcggcttgggacgcggtcatttctgcgacaccagaacaaactaaggacgtggaagcccgctttggtaaggatattccagcgttcactattccggttggctatgttgataatgctacgttaaaagccgcgccggtgaagtttgaccaacgacaaaaagacctcgtcgtgcaagttgcgcggctggcacctgaaaagcaacagaatcattcaatcgaagcctttgttgaagttcacaagcattttcctgatgccaagttggaattatggggttatgcgaacggggatattgaaaagcaactacatgcacaagttgctgcagcgcacttggaagatgtggtattgttcaaggggtataccacggatgtcaatgccgtttacaaccgggcccaattaggacttttgccaagtcgagctgaaggattctcattgatgttgctagaagctcaagcccatgggttaccaatggttgccaatgacgtgaagtacggcccgagtgatattattcaggatcataagagtggaatcctaacgacagacggcgatgtgcaacaattgaccaaaacgattttagaattgttgaagaatcaagggcagctggcacaatacagtgctcaggcctatgaaaatgccaagcgttattcagaagaagccgttttcaaacagtggcaagcattgttagattactttaagcctgctaaggtcacggcttaagtagatttgacggcaagggaggacgcaaaatgttaatgattatgaccatttatgggaccgttaagatgtttacccgaatgatcgtgtactgtggcatcggtggtcttgtcctaattgttcgtcaccataatcgtaagaagcggcgtaacgagatggacgagggaactaagcggatcatgcgtaatacccccaaggatgagaacggtaagtatccgtgggagaagtaaggtaccattggtttttaagttaagtatctaattgaaaagacctgtcagacgaagctaatcgtctgacaggtcttttcggctaatttatcgttaaattaacgtttctgaatggccaacaaatatggcggcacatggacttgattaataaactgatattgtaggacttggaattgatgctggtctaaatttgttacgtaatccaaaacggcttgtgcttctgtcgcaccaccgggatgaccagcatagactagcaggataatgagtccgttggtgacgaggcgttcctgaatggcttttatggccgttaacgttgtcgttggtttcgtaatgatttgtttatcgccacctggtaaatagcccaggttaaagacggcacacttgataggttgatcagcggcaatcttatctgcgatgtgttcatggcccgtttgccacagagtgacttgatgggtgagcgctgctttatctaaggcagttgtcgtcgcttcaatggccgctgattgaatgtcgaacccgtcgacgtgaccagtagtcccgaccagcttggcgaggtagacggtatcatggccgttgccaaccgtcgcgtcaatcacatggtcaccgggattgacgacttggttcattagcgcgtggctataagctaatgccgaactgagttgaatgaatgttacccccttgttgaattcatgaattagggccgcaatcgaagcggtccgtgccgataacgcgtactaaaacgcgcacttatatatagtaaaacacttccaagtaaaaggccaccgattgtatcgctgggatagtggacgcccacgatgacccggctgatcatcattaacaagatggccgttatgccgagggcagtgagccagccagtcaaggcattgcggtgccagtagtcaaatgccaacacgagcagactaccgataaggacggtcgttgttgtcgagtgcccgctggggtaactataccccccaatttggacaagtcgccaagcggttggccgtggccgcatgatgacctgtttgatgagataattaccgtagccggcaatcagccaggtggtgacccaaaagaagactgcgccgcgtgggttatggcccagccagagtgccaggccgataatcaacgtgattatggtgatggtgtggggattgccaagctgcgtatacgtgaccatcgcgtgttgaaaccactggggactatgatgccaaaaattagcaaccgtggtatcaaagtgtgttaaccaaggcgcccgttgccataccgcggccgtccagcctaaccagcctataaatataagtagaatcaaactgtccgaacgttgccaggatcgttgcttcaatactgattcctccgataaataaattattgacattattatagcattttttatcaggggtccgattaatgccgatgataaaatttatcgccagcggggcttggacccttgaaaaaaacgtgctggtttgctactatgaaaacaataactttacgactctgagaaggaatagtagtggctggtgttttgcagaaactccgtggtagttgcaaacggggattcaccaatcatgaactcaccttcgagtcttccggctgaacaagattgtaggtacggacgtggtttcgcgttaagattcccaagaggccacggtaacgtggaatcataggtggtaccgcggaacctgttttcgtcctataagcttaattggcttataggatttttttgttttttaactgcttttactgagttgaagcatgaaaatgccatcttgaatagtcagttggaaagtcgcaatgctagcttttacatacaaggcagcaagaaaggggcactactatggcatacaaccataaagtcattgaacgcaaatggcaacattattggaaggaaaacaaaaccttcaaaacattagatacgacggataagaagaagtattacgccttagacatgttcccatacccatctggtcaaggattacacgttggacatcctgaagggtatacggccacggatattatgtcacggttcaagcggatgcaagggtacaatgtcttacatccaatgggttgggacgcattcggtttacccgctgaacaatatgcgctcaagacggggcataacccgaaggactttacggccaagaacatcaaaaacttcaaacgtcagattcggtcattaggtttttcatatgactgggaccgtgaagtgaatacgactgatccaagttactacaagtggacgcagtggatctttgaacagctctataagaagggcttggcttacgaatctgaaacgttggtcaactgggctcctgatatgatgggtggaacggttgtttctaacgaagaagtagttgatggtaagacggaacgcggtggctatgatgtttaccgggtgccaatgaagcaatggagcctcaaaatcacggcctatgcggaccggttgattgatgacctggacgatattgattggccagaaaacatcaaagagcaacaacgtaactggattggccgctcagttggcgcatccattcgtttcaaggttgctggtcaacctgacgataccgagattgaagtgttctcaacgcggccagacacgctgtttggcgcaagttacatggtcttggcacctgaacacgacttagttgaacaattgacgacacccgaacaagcggacgctatcaaagcatacaaagctaaaatcgccagcaagtcagaccttgaacggactgatttgaataaggacaagaccggggtcttcactggtagctacggcatcaacccggttaatggtgaaaaactgccaatctggattgccgattacgttctggcttcatatggaactggggccatcatggcagtgcctgctcatgatgatcgggactttgaatttgcacaaaaatttgatttgccaatcaaacctgtcattgcgggtgataatgattatgaccaacaagcttacactggcgacggggaacacatcaactcaggttttgttgacggtttagctaagcaaccagctattgataagatgattgactggttaggtgaacaccataccggtgaaaagaaggtcaactatcggttacgtgattggatcttctcacggcaacggtactggggcgaaccgattccagttattcactgggaagatggcgaaacgacgctggttcctgaagatgaactaccattgcggttaccagcaactaagaacctggaaccatcaggaactggtgaaagcccgttagcgaatatcgacgactgggtaaatgtcgtcgatgaaaacggtcgtaaggggaagcgtgaaaccaacacgatgccacaatgggccgggagttcatggtacttcttgcgttacgttgatccgcacaaccgtgaagctttggccgattatgataagttgaagtactggtcacccgttgacttatacgtgggcggtgcagaacacgcggtcttacatctgctttacgcacgtttctggcacaagttcttatatgacttaggcgttgtgccaaccaaggaaccattccagaagttagttaaccaagggatgattttgggtgataatcacgaaaagatgtctaagtcgcgggggaacgtggttaaccccgatgatattgttgaccaatatggtgccgatacgttgcggttatacgaaatgttcatgggaccattggaagcttcgattccgtggagtaccgatgggttacatggcgccaataagtggatcgagcgggtttggcgcttaatgatcgatgaaaacaatcgtgttcgcgaccgaatcacgaccatcaatgatggtaagttgacgaaaatctacaacgaaaccgttaagaaagtcacggaagactatgaagctatgcgctttaacattgcgatttcgcaaatgatggtcttcgtaaacgaagcatacaaggtcgacgatttaccaatcatttatatcgaaggctttgtgaagttactgtcaccgattgcaccacatttgtcggaagaactatggtcattattaggccatgatgacacgatcacctacgccacttggccaacgtatgacgaatctaagttagtagaagacacggtccaaatcgtgcttcaagttaatggtaaggttcgctcgcacgccgaagtcgctaaggatatgggcaaggatgaacttgaaaaactagccctggcggatgaaaaaatccaggaatttacggccggcaagacagttcgtaaagtgattgccattcctggtaaactggttaacgtggttgccaactaagtaccacgaccagtatcaacttaaatgaatatcgcttaaattaatcgtgatggtgactgacaattgttggttgctatcacgattttttaactactcacagaactaattagtgcggttacgattgatttggttaagtgaataaagattctgaggacgttctggttcggtttgggagacaaatcacacgtgtttttggtgggcagagtgtgtgcaaccgcctatgcttaacttaaaactagcagtaacgtggtttaatcagcggaaatggttatcatggcggcactctgctgtaatcgaatttgagaccgcatcgtggccgctggtaaagcgtacggattggtcttttttctgtatcagccatagggtatcggacggcggtacggttcgccaatagctggtgcagttgtcaagaccttatcattaaagttcggttaaactcacgcataaggccggaattgaattgcaacttgtttgtttttcatctaaaatgattaggattgaattaagaaagtgggttacgaacatgtctgaggaatcaaaagctaatcagccccagaatgcacacgtgaattctgaagccgaagcgcaccagaagatggtgcgcgggtcggcttggatgacggctgggagtctcttttcacgggtgctcggggcgatttatattatcccgtgggttatctggatgggcgctgattatacgcaaggtaacgcgctttatgccaagggatataatatttatagttttttcctgctaattgcgatcgggggaattccgtccgcaatttctaaacaactttccgaatataatgcgatgaatgaatatgccgttggacagcgcttattcaagcggggcttgttgttgacgtcagcctttgggattattggtgccattattttatggtttggtgctggcttgatttcaacagcttttgggggctatgatgccaatctgattcccgtcttgcatgcgttggctattgccttggtgattctgccatcgatgtctttgacccggggattcttccaagggtatcaacagatggcgccgtccgcaatctcacagttcgtggaacaagtttttcgggtcatctatatgttgggtgcgacgtatttcatcatgcgcgtcgctcacggcgattgggtgaatgccgtgacccaatcgacattcgcagcattcgtcggggcggctgccagcttcttattactcggttggtattatttccgcaaacggcccgagctaaatgccttagctgctcagagtgagaacaaactagttattccagtctggcaattgttccgcgatattattattcaggcgattccatttattgtgatcgataccgcaacgacagtcttcaacctgttggatcaagcaacgttccaaccgatgatgcggctggtttaccatttgggtactaagcagatcgatacgttgtatgcttactttgcatttaatgcgaacaaattggtgatgatcattgtgtcattggcgtctgcgattgccgtgacggtcgtgccgattttatctgaatcattggccagtcataatatgcgtaatattcgtaaacagttggaagattcgattattttattcctatttatcatgattcccggagcgctggggatggccgcagtggcacaaccacttaacacgctcttttatagttatgatcaaattgggaccttgattctgcatatctcagcatttaccgcgattgctttaggcttttttacggtgatttcggcgctgatgcaaggcctatcacgcaaccgcgatattattcgctattacttgatcggcttactggtcaaaatcgtgattcagttaccatgtatctatttcctatcaacggcggggcccctggttgcgaccgcgattgggatgatggttgcgagtctgatggcgatgtatgatttggaagtcaactttggaattcggtacgtgaagttattaccaaaaatcaatcgaattttagtttattcgattttaacgtatgtcacggcacgattagttgtttatgggctgaactttgtgttgaatgagcacagtaagacgcaatcgttcttgatcgtggccctagcagttatcgctggtggtgcggtttacgtttacttagcactccgttcgcggatggctgatttgatgattggaacgaaagctgctgggttacgacggaaattacggattaaataggtgaattatgcgagtagataaatttttacatgcgatgcgaattggcacgcggactcaagtacgtcgtctgattaaagatggtcatatcactgccaatggtgagccagtaatctctggcaaacaacagatcaaccctggcagtgacaccgtctttttagatgacgtgcaggtccgttaccaacaatacttctattatgtgatgaataagccagtcggggtcatcacggcaacgacggattccgctgcgaaaacggtgatggacctgttcaatacgacggattttcgtgacgatctatttcccgtgggtcgtctcgataaagatactgagggaatcttggtcattacgaacgatggggccctatcgcacgacctattgtcgccgaaccaccatgttacgaaggtctatgaggctgaagtaacgggggaaatcactgcagctcaattggctaattttaatgatgggatcacgttaaaggacgggactgaattgcaaccggctcaggctgagattgttcaattccatgaaatcgagaattttaccacgattcgaatcatgatccatgaaggcaagtatcaccaagttaagcggatggtcggaacgttaggtgaacgggtcgtcgggttacggcgaatcaagtttggttcgttaacgctacccgttggcttattagcggggaactatcgtgcgctgactgatgacgaactaacagcgttgaaggcggatgcgaaccaacccgtaggcgaatagtgcgtgttacgaattcggccactctggtttaaattaaatcattaagccccaactaactatgaattcaagcatggttagttgaggcttttttagcataatgtcgttggcttgttcgtgttcattatggtccagctagctaagggcgttcaatctgactaaagcggtgcatgtaagtcggaatgcgggtactgatttgatgcggcaagacgacgtaccgcgttgcagcgaggtcatcggcaatggcactgtgcaagtagaccgcgctgagaacggcatcggtgaaattatgaaattgacttacgaagccaccaatcataccagccaacgtgtcacccatgccgccggtcgccatggccggagtgccgccggggttgaaccagactcgttcgtcagtgtagacggtcgtgcgatgagctttgaccacggccgtaacacctaaccgttgttgcgcgtcatgattggcagttggggtttgatctttgatcgcgatgccgctaagtcgttgccattccatttggtgtggcgtgaccacgatgtccgtggcgggtaaggtgcgggcctgctgtgcaagcaaggtcagcgccgaaccatcgatgaccaatcgttgtgggacgtgcgtcgcggcgagaacggcggtcagtaactgatcagcgacggtatctgttccaaggcctggaccgatgacgataacgtccattcctgctagcaggtttaataaggtgtccgtttgatgatagtcaatgaccatggcttcgggtagccgagcatgtagactcgtgaaattagacgggtcggtagcgaccgtcaccagaccggcaccactatatgttgcggccgttgcggccatgatgatagcaccaccaaaattttgattacccccaatcagcatgattcggccgtaattgcctttgtgagaatcagccggtcgtttgataatcgttcggctaacaatttcagttgtaataggttgcataaaatgaccagctttctaagttaatttactttgagtataccattttccaaaagcggttacttacgattattaagttgacgacagctatgataaaattaaggtaacaatatgtgggaggaatttaacatgtcagttgattggaaaaatgaagcaactaagcatcaagatgattatttagcagatttaaccaccatgctccgcgtaccgagctttcgtgacgatagccaggcgacggatgatgcacccttaggccctggtcctaagcaagcgttaaccacgtttttagcgattgcggaacgcgacggctttaagaccaagaacattgataacttggtcggttatgctgaaattggtgagggggatgaaaccttggcaattttagcccatgtggatgaaatgcctgctggtaacggctgggatacggaccccttcgaaccaaccatcaaggatggcaagatgtatgcccgcggcgtttccgacgataaaggcccgggaatggcggcctactatggcttaaagattgtcaaagaacttggcttgaagctcaataagaagattcgctttatcgttgggacagatgaggaaagtaattggactggaatgaaacgctactttgaagttgaaccagcgccaaccttgggcttctctccagatgccatgttcccgttgatcaatggtgaaaagggaaatgtgagtctgcaattacacttcggtcatgaagataatggcgactttaaccttgtttcttttgattctggcttgcgtgaaaatatggtgccgcgtgatgccgaagccgtggtcgcgacggatgacaacgagcagttggcggccgacttcacagcgttcctggaccagcaaccagtaactggtgaattaacggtcgttcctgaaggcgttaagctggaagttgttggaaaggccgcccatgggatggaaccacgtaacgggatcaatgccggaacctaccttgcaacgttcttgactaactatgcctttgctgatgatgccgctgctttcttagacttcgtggctaataagctacacgatgattcacgggcgaaccagttaggcttagcttacaaggatgacgttatgggtgatttgacgatgaatgtcgggttactcagcttcgaccatcaaaagggtggtgcgttaacgttgaacttccgttatccgaagggaatcgaacctgctgatttaacggcgaaagtccaagcgcagttaccagctggtgccacggtcacgcagggtgacttcatggtgccacattacgttgaccctgaagacctgatcgtcaaggatttgatggacgtttaccggcgtcaaactggtgacacggcctcacaaccacaaattgttggtggtgggacttatggccggatgatggctcgtggggttgcctttggggcactcttcccagataccgaagatacgatgcaccaagccaatgaattccaaccaattgacgaattaatggctgcaatggcgatttacgctgaatcaattgccgtgttagcaaccgacaaatagtgatcctttaatggagggtgatggttatgacgatggttaaacgcattttagtcggcatcgatacgagtcctcagtcccaattagctttaacgaaagcaattaagatcgcggtcgagcaaaatgccgctttggatattgtgacggtcattaatactgagaaatttattggtgtgactcaagggccgatgggttttggcgcaacgacaccgcaggcattgaacgaattgacggccggtcttaaagcgaatctcgctaaggctcgccaacaagcgatggccgcgggtgtcagcgatgtgcgggttcacttacattcaggtaattcgaagttattgttagcgacgactttaccggaccgctatggcactgacttgatcgttgttggggccacaggtcttaacaacgtggcacgggtgttaattggctctaatgctgcttatgtgattcgcaatgctacctgtgacacgttggtggtgcgcacagatgctgatcaacagccagtcaaactgccaaagcataccactcgtcggctttaattgaaatttttaggacatccgatagtgtgtccggataaacatttgagcggctttttcaagctcgatatcggacacagagaaaaccgactcacggtggaccgttatcatccatgacagattaactggtaggacacagactaaatagttgtttcgagaatgtacaaattctcgaaacaactattttttattcactccgaatttgttggtggggcgctgtttatgaaaaaaatacataacccatacgttatttttacattaagccaacattcccgatacgttggtctggcatgattaaagagtaatctaataaattacaaataaaaggtcgaggggatatgaatatgggaattaccttgcagaacatcacaaagacgtatgataaggcgaaacagccagttttaaacgatgtaaatgccgagattcaagacggggagttattcgtgattgttgggccatccggttgtggtaaaagtacgctgctgcggatgattgccggtattattccaattactagtggaaagctggccatcaatggtcagatcatgaatgcagtcccaccaaaagatcgaaaactgtcaatggtttttcaaagttatgccttgtacccttttttggacgtggctgccaacgttgcgtttggtttacaagcacgaaaaatgccggccgcggaagtcgagcgtcggatcaatgccgcgttggaaatggtcaatttgacggcttatcgtgaccgcaagccgcgcgaactatctggtggtcaacggcaacgagtagctttggctcgggcgattgccagtgatgctaaggtttgcctgatggacgaaccgttatcaaaccttgatgcgcaactacgcgtgcgaatgcggaccgaaattcgcgaactgcaacgtaagctcggattgacattgatttatgtcacccatgaccaaactgaagcgatgaccatggccgatcacgtaatggtgttaaatgagcgtcacgtgcaacagattgatacaccgttagatatttataatcatcctgctaatcatttcgtcgctgaattcttcggtacgccacagattaatttactgccagtggtgacgaaaaccgctcgtaatttacacgtcgcggagggctttcagattgcgcttaaccaaccattaaacgcggggagctatacgattggtatccgacctaatcagctaaacgcagtaccagttaccgatgagcgcggtaatggcaaggtcacgaatgtcgagacactgggcgagatgacgattatcgaagtgcaggctgataacgggacggcattgcgagttgcacaatctggtcaggtccaattaccacttgaacaacgggtgaatgtaaccgttaatggtaagatcttcatttttgatgagcacgaacaactgattgctgaagaggagggtgttactagtgatcaactcgtttccgtcgattaagcgacgccttaagccgaaacaatcgccagatgcgcatgaccaagcaactgtgcacaccggcagttttgaattaaagcgtaatgataaatattattcttggctatttcttgggccctcaatactcgccctcagtgtttttgttttctatccaatgttacgcaccttgtacctaagctttttcttgactaatagtcttggtgaaccaaccgtctttgttggtttgcaaaattaccttaatttgctgacgactaagagttatcttgctagtctgcaagccactggaatctatgtcgtgggtgtgacggtgttcacgttaattggggggttactgttagcggccgctgccaatcaaagggttcggggtatcgagctatttcgaactatgtttacctcgactatgggagtgtctgtctcggtctccgcaattttctggttattcatgtttaatccatccgtgggcttgttgaataaggtggccatctggatgcacttaccggcaattaattggttaacggagccacactgggccatggtggcgattattatgacgagcgtttggatgcacctcggatttactttcctgatcttttttggggcattgcaagttgtgcctaaaaccttatatgatgcggccgatgtggcggggaccagtcggcgttatcagttcatccatatcacgttgccaatgatttcccccacactcttctttgcggcggtgattacgttgatctcagcgttcaagagtttcggattgattgacttgatgactgcgggtgggcctacgaacgccaccaacttattagtttaccgtatttatcgggatgccttcgttgatggtaactatgcgcttgctagcacggaatcgatcatactagcaatcattattgcagcgattacggtaatccaattcaaacttttagcaaagcgggtgcattactaatggaaaatacaatggctactcaagccttgattcgacatcgaatcggtatcggattccggtacttgttattaattacattaacgttagtcattattttaccgtttgttttagggttgtggaccagctttttaccaacgacgactattgcgaaaggatcactgagcggaaccctttcttggcagaactatcaggatgcgttcaccaaaacacccattcttcgctacttatttaacagtttagtgatctcaatcattcagatgattgctcatctgttttttgcatcaattgccgcctacgcctttgtgtttttggaatttaagtatcgggatgcgttgttctacttggtcttggcaactatgatgctaccatttgaagctgaagtgatcccgaactttcacacggtccgtgcgatgcacttgttgaatcactatgcggtgatggttatcccgttcttaacttcggcctttggtatcttcatgttacgacaagcctttttgcaaattccgcgagacttaaaggaagccgctgatgttgatggtctctcacactggcaattttactgtcgcgttgccttaccatactcacggattagtttattgacgctagctgcttacagctttttaggaagctggaaccaatatttatggccaatgctgaccacgttttcaaatcggctacgtccggtccaagatggattgcggcaattgcattcggaggaaaccgctacgaattggggactcgttcaggcgagtgccgccatcgtggtgattccaacattgattgtccttttctgggggcaacactactttaaatctggattgaatgaaggttcggtgaaatgatgaagataacgcggaagtggcagtggctagccggtatgatggctgtcctcttggtagtgggtggggtcgcttatagtcggacccgtgtccatgcggatagtagtcgcattaaagtggtgttttggcatgagatgaaaggtcctggtcaacaagcgattgacgcttacgttaaagcgtttaatcaccaacagtccaagtatgaagttgtagccgagtttgagggtggctataatggcgtcattcaaaaaatcttgaatacgcatgggacggccgcgtcaccagcgctatttcaatcgatggatatttccaccagtcagatgtatcacagtggtttcacgacaccgatgcagaaatttattgaccgtgaccattacgatgctgatcaaatcattccgggcgccaaggcgatcgtgatgcgcgacaatcaattgctagcaatgccgtttaatgcatcgcaaacggcgctttattataataagagggtcttgcgtcagtacgggattacgccgccaccagtggatccgacttacgatgatatcacgcgagtcgctaaggccatccacgacaaatcccacggcaaagtcaagggaatgacaatggaggcctattcgtggctattcgagcagctggtcgctaacgcaggtgttcccgttgccaatcatgataatggtcatactggcaatgcgactaaggtcgactttacgagtcccgcggcgatcaatgcgatgaagtgggttaaagaaaatattgactatagtgactttatgaactttggttcgggtggtaatgctgctgcaaatgaagcagcttctttcttggcaggccatttgggtatcttcatgcaatcgtccgcgaacacgggtcagttgtatcaagtgctcaaaaatgatctaggtgtcacatattttccacggccgaatggtcagagagccaacggatcgtaatgcaacaattgttcacagcctcggtcaatgcggtgattaccaataactttgagttagcccaacaagtccgggcagccatgtaatcgagcgcaattgtgctagtgcggcattcaaagattgtcgtttggtaatacgacactacccgcgctacctagttagctggtcgcgagtcattaagaagtttctgtattgtttgctcgctagattgtgcgtaataaaagcgccagtccccattatcgggactggcgcttttagcatgattaattaaactgtggttggattgcgaatcttgcctaattcagaatcgatttgagccagcactgcttgttggttagcaggtttttccaagtcgtactgttgtaaatcaatcttcattttagggctagcatcgtattcatcgtaccatttccgataagcggtccacatcttatagtaataagattccagttcagggttgtggtcgaactgttcgtagtcgcgaccacgcttcttgatccggtaaagaatcgtatcgaagtcagtttcagagtagaccatcaagtctggtgccttcttaggcagttcagtcaattcggtcatcatattgtctagtaattgcaagtaaacattcaattcagtatcagagatgtttccttcagcgttgttttctttggtgaagagggcatcttcatagatggagcggtcgaggacgttgttatcgtcggccaatgccttcttgatcattgcaaaacgtttgttgaggaaatagatttgtaataggaacccgtaattcttaggatccgaatagtaaagtggcaatacggggttgtcgccaaccggttcgtaaaatgccttagttccaaggtggtcagcaattaaccccgttaacgtggttttgccgaccccaatcattcctgctgttattatcaccatgatagcccctctttataaaaaattgcacaatatattgtatctcaaaaaaagttttaataccatatagacttttaatgaaaaatttgcttgggagctattttcacttattttttagcctgttcctttaataaatcacgaatttcttctagatattgcgcggaaacatcgacttcttcttcctcgggttcttctggttcatttttaaccactttattaataattttcaccagaatgaaaacaacgatggcgacgatgaagaaattaatgatggcatttagaaaggacccgtacttaaaggtagcatcaccgatactgaactttagattggataaatcaactttgcctaagaaaatcccaatcagtggattaattaagttgtctgtcaacgatttaacaatggccgtaaaagcggacccaataataaccccaacggccaaatcaatcacgttaccgcgggcaataaattccttgaattctttgatcatgcgactcgcactcctttattaattgactgttaacagtatagccaaaatcaaacgctgactcaatcaatataccaatctaatttaaccgtaagcttgtccctaactaaagcatacccatactaatttgaggtggtatcatgattagttttgtttggatagtgacttaatgttgttctgaatgattgttgtggtgcatttgagactagttaatggttttagttagttgggctgttgactgacaagctagatgacttagcgtgtgtgacatccggtcaaaatgagtctgtgaaaagcagtctcaagtaatggggaagtcgtttcaatattagtagggattttcacgaatactaataatatggtagtaggttaaggtgttgaccagcgaatcagaattaacagcaccatttgggtaaagtcgtcaacttagttagctgctaaaaacggctctctctgatatagagaaagtcgttttggcagtgtttcgagatcataaatccaaataactaattcgtcttattgtcagatgctttagcttgagcctttcgccgaaccaacgtggctaacttactctgagtggctttgacggcaacggggtcttcaaagtcaatttgagccagccgagggtaacgacggataaagaacaaccaggtcagagcaataaacagcattagaatcagtgctaagacgcccatctcaggaagagcagaattaccagtcattaaggtctgccgcaagccgttgacgctgtaactcattggtaaccacgggtggattgtttggaaaaagtgacctgacagctgaattggatacgttccggctgaaccaccgagctgtaagactagtagtaccatactgaagaaggcgccagctttgccgaagacaaggttaagccaagcgacgatcgtcatgaagagtagcgccgttagcgtgagtaacaaccaagtggcaaacggatgaatcgggctgagtccgttgattaacatcatcaagccgagcataatcgtactttccatgattgaaaagacgagcatgatgctggccttgctactccaccaatccagtgccgattgcgggtgtttgcgtggggtatacatatcaaacatcatattgagggcgagcgcgccgacaaataacgagacacttaacatatacggcgccataccagtaccgttgtttggtacatcatcacggtcctggtgagttgtagtgacgggtttggcaacttgttgatacgtcagttttgatggattgagattccccttgcttgcggccgttcctaatttggtcgctaatgcttggttaccagtttgaatcttattaccagcggttgtaacttggttagcacccacggctagttgttgagccccggtggctaattggccattgccactagtgagttgctgactcccattaacgagtgcaatacccgttgtgccgagttgatgtaagccggtggtgacttgttgactgcccgtaactaactgtgagatgccagttgttaagctgggtaggttggtctgtgcagtttgaagacccgtagccacgcggctggcaccttgtgttagctggttgccctgggtgctgagttgacgcgtgcccgcggtcagctgttgagaacccgcagcaacttgtcccgcacccgtagccagttggtgacttctctgattgagcaagttggtgttagcatccagtgttttaaagccttgggtgagttgctggctattagttgtgagcattgttgttccgctagccaagtttgtcgcaccagtagtgacggccccaatgccattagtgagattaggtaggaccgtgttcagctgggttagactagtcctcagtttgttagccgcgttaccagcagattgaataccggtcgtcagtgattgcgcaccggtagtgagttgggtgaccgtggagacaaggtcagcctgctgttgagtcgtggcgctgagggccctagtcaaagcagtcgtatctagagccggttgcgtcgactgggcgatggccgtggttaaactcgcaagggcggcgttgatggcgtcacggttagcggattgatcaaccgttgccaaaatggctgatttttgtgccgcagtcaaattttgactgttagcggttgcggcgacattgtcgtgaagcgccgcactagttttaatagccgatgtcagcgcacttagcgcggttttaacggacgataagtcggtaccagcagcctgctttttcagcgctgccacggttgcgctaatcgtggcttgattgttggttggttgcttaagttgcgtctgcaatttttgcaagtcgatggtgagggactgactgttctgacctagtgtctggatgccagtagttagctgacttgagtcgctcgttagggccgtcgttttagccgttaactgagcggtctgtgcttgtagttgattagcaccttgactaagcttgctggcaccagtgttgaccttgccgacaccggtcacataagcgtttaaaccggaactaagttgttgcgtaccagtcgccagttgagcggtaccactactgaattgttgcgtgccactggccacctggtgggcaccagtattgactttgacagtcccagtattcactcgctgggcgccagcaacgtattgatcaacaccttgatttaaagtttgaaccccagtgttgagttgagccatgccagcaactaactgattacttttgacgagcagttgtgttagaccggcaactactttttggttacccacctgtagttgtgaaatgccattaagatattggtttaaaccgaccgtcagtgtttgactcccttgttttagtttcagcgaactagttgcaagggtgtccaggttggtggcgattttttggttggcagtttggagctgctgaccaccggtggctagcttttgattattagtagcagctgttttgaggccactgtcaagttgtttgatagcggcaaacatcgttttggcatagctcgttgtaatcgtttgggcgacggatgatcgaatcgaagtgaccgctgaatcggccatcttgctagcgacgaagttatgtccagcacttgtatcataatgtagcaccatggcttgtggttggtgattgagtaaggtggtcgcgtggcgcgaaaaattggttggaatcgtgagcaccatataatagcgaccatttttcaagccagcttgtgcctgacttgcgttgacttgttgaaacttcaaagcgctagatttttttaaattcgttgttaaattgcgcccaacactgagatgcttcccttggtacgtgactggctgatcatgattgacgacggctacaggtaaattatttaaccgaccgtatggatcccacattgatcgtaaaaatgtcacggcataaattgatggaatgaacataatgattgccatgacgataatcattagtttgtgtttgcgcatatacgcccattctgctttaatcatctttacttgcgctcccttaattgtctattttgtatgaaaccccgtgtgtgcattaaagaggataacaggtttcagaaatagcaccacatcatcaagacagcatgtggggtttaaaccccattttgagtgcaagtggggtttaaaattaagggtaagttatgattttaaaaatattatgggtatacatagcatgaattgagctgtcatcaattatgataaaaatgtgttagttaggttactggtcatcagtaaatgtgcgtcctacatacaccttctaggttgagcggcaattgctataacatagccaacgtcgattcggctgcgggattgtccgaacgtggaaaagaagccccttaccatgatatttcaaagtaaggggcttggtatgagataagcagttaagatttccagacaattagttcatctggtttgaagtagagttgttggctaacaccaaaccgaactaagtattgatctttagctgcgtagtaggcaatgatcgttcccacaattcccaaatatggttttggtaacttgacggtcgttccgatttttaaagttgacatgattgaaaacctcctaaattttagtcattatcaaggccgtgacgacggtaggcatagaagaagatgccacaggtaatcacgagccatccgagttgcgtcagtacctcacgaagcgtccatgaaaagccaccagtggtatacgaggcggtaatatagtgattaagcgtgctgctatacagataactgctaaaggatttaagggtggtattgaactgttcgaaattcggtatcaggcttaaaatcagcatcattggaatactgtagacgcctgcttgagtttgactattagcaatcagaccaataatgtatccgagcacgagactcgttaaactagtgataatagtaatcaataaaaagtttcctaagtgaatttgcgaccaactggcgccgcttagggggaccagtatcaaattggttacagtcataatagctagtggtggcaataaactaccgataaaaaattcgggcccggtaatggaagaggtcattaggacacgtaacgtatggtgttctttttcttcggctaagggataactcgtcatcatgatgccacccataacgatattaaagcatagtcccattcccagtaatagggaaatcagggcgacgtgtgatggtgctttactttgcataatactcttaatgaaaacgacgtacaaaatggccatgattggggcagtcattagactcatatttgaaatgatcagtcttaatttaagaccgaataaggcttttattttggttactgataaactcattttaggctccttccagttacggttaaaaagacatcttcaagggtcggctcgcacgagtgaatcgtctcaagttgcccagaaagcatccactgattaatctgataggtcgtctcaggagatgcggggagtaacaaatcttgcgctgccgatgcaatgtggacgcgatactgctggtcgcgattatattttaattgcaatgcttgtggggctgcacattctgcgatgcggccagcgttgagtaaggcgacacgattgcagagacgagtggcttccagcatatcatgagtcgttagcagaatcgctgtaccctggtcgcgtaattccctaatcagtgcgtgaattgcttgggtcgtgcggggatctaaaccactggttggctcatcgaggaacaagacttgcggttggtgaagaattgctcgggccagaactagccgttgacgcataccttgagataacttaccagcgagttttttcttatgttgactgagaccaactcgttcaagtaacttatcaacacgtgcaaccgggacaccaaacattttcgcgaagaatagtaggttttggtataccgataatttgtcgtaaagcccactttgatgcgtgacgatgccgattttttcatagcggtgttcgtcgtatgcttggacagactgacccaggacgtaggcttcaccgttcgttggtaataattgtccggttagaattttaatggtggttgtttttcccgatcccgagggacctaaaaagccaaaaatttcacctggttggacggtaaaactaacttggtccagcgcggtcgtattttgaaatgatttggcaatgttaatcacttcgattgcattttttattgtcatcgttgatcgctgactcctttaaatttgatttggaagcgtagtggcttctacaaaatctagtttactggaacaatcgtcgaatgtgattaaatcaaggtgtaatggggcatattggggccgaatggtgcattatttaggctgaatggtgtcctaaaaattgatcaaagcttttaaatcagtgagtttaccgcgagagaggggcagtttacttttgtttttcaagattaacgtgtaactatttcgggagtaactgattagttccgcgatttgttgtaaattaaccaagtaagaacgatgacagcggaagaagccgagcgtcgtcaattgttgttctaattcgctcattgtttgcgatgacgtgaattgttcgccactgacgttcagttgactgaccccgttgacactttcaataaaatcgatctcgttggggctgaaaaagactgttttatcttcaaccttacttgcaattttaaaaattggtctaggtgtatcttctgaagtgtgtgcggaatcggaactgctttcggtcgccaaatcagtcaactcgaggccctggtttggtcgatagcggaagatagtcgtactggttaggacaagttcttctaatgagtaggaggtcagcagtacggtgacgccgtgttcgcgagtataggctaaggctgctaagtacagctcaatgccagcgttggtcaagttggtcaggggactttcaattagtaacaagtccggttgtaggatgaacgcccgcagtaaggccagacgttgttgttgatcaaaggataagtgcttgatcttagtatgggcgacgtctttgagtgcgaaatactgcaaaatgtcatccaggtccgtctcaaaggtgctgatgtgttgaaaggtcttcaaataagtcgagactgttaattgcggataaaagccgtcatcatgaaagatggcttggatacgtgcgggagtgaggccagtcatcacgccactagtttggggtgtcgtttggcgtaataggttaaagagggtcgttgcctcaacgtggctcatctgaatgccgatgttactttgcgctggaatggtgagtgtgaaatcttttaaaatcgtttggtgtgcttgttgtttaaagatgttgcttaactgaattgtttgcatggtgagaacctcgttgtttttagtgtctgagtgaggtggttagaaaaaggccatatcactcaaacaaattggcaaatctgatgtagacagtaacaatataccatatcgaagtaggcagttgtggtttgtcctgattaagaccgttatgtcaaaatgacagctgacatgatgcaaaataccgcaataaaaacaggacaatggacggccggcattcgtatggcgggtcaatatcctgttttttaaaattaatgtttgatgattgaatgactaacgagattgatcaagtggtcataaaacacttggtcaattgataataatagcaatatcagaaatggccaaccaaacggtctctgtgggtgattataagcaattactggcatcactgttaagcccatgtggatgaaacttcctaataaaatcagccacaagctgattagggcccattgcgatttttgccgcatgtttatgcgcctccataacaattaagtatggcacagcgattagtgcttgaccaattgattccagaagcaggcaaagtcataagttgtgactgaaccgccaagctagaatttgtttttgaatttcaaccaatttagatagtgatcatgggcttttttcagttgtcggtagcgccggggttgtttgcggtaaaaatcctgatgataattttctgctggccaaaattgctgtaagggctcaatggccacgacaattggtttttgataacgttgcgagtccacaagcgcttgtttggatgcttgtgcaatggtcaattgatgttgattagcataaaaaatgactggccggtattggctaccgcgatcattgatttgtccaaagcggtcggtcggatcaattagttgccaataaatatcgacaagattttgatacgagattttacgggaatcgtatctgatttccacggcttcaacgtgccccgtatattgaccactaacttgttcataggtcggttgggcccacgaaccaccggtataaccagaaatcacattattaataccgggacgctgatcaaagggctcaaccatgcaccaaaagcacccaccagcaaagactgcccgttcttcataaggcgaactaaggggtgggtaagccgatacattgtttttagtcggcatgggtgcgttgccagtgatggcaagataaaagtccataacatccggggtcaagttattccgcatagctaatggtcgcaaatcagcttcgagctgttttagttgcccagtcggcgatagctgttgccgattattcttggcctggactagtaaatggcgttcccagtcacgcgtcgccgggttgatgattaaattgtataagtcgcgcattaaggcttcaggttttgttttcatggtgtctccttaactggcttatttgccgagtattagcacgtacttgcattttggctgatttgattttagcacggtgctttggtagcacataatgttatgatttgttttctatcaccctgtcgtaagctactctaacaagaaatgcaaccagatgatattgatgtgatcgttagttgcatcttagttataagcaccgtttggccgacgtcaaaaatggcggctattattgtgggtattattcacccaagtccaatttgattggaaaagcttgctatgaagtgtggttgatagtttataatgaatcgcatgcgaaaaaaggaggaactaaaattggatgatgaagtcgccaaatatacaacccaagagatttcagtattagttgggatgagtgtctctcaggtccattactatgatcgcctgggcctaattcctaatctaagacgatctgagaatgggtatcgtgtttttacggaaaagaatctgatttggatgaaaaatttgaagatttttattgattccgaaatgccgttgaaggatattcgtcaactaactgatttagttgttcaaggcaagcaagcaacagcggaaaagcgtcaagcgattgttgaacatcatctgaaagaattagagaaaaaacaggctgaacttaagaaacaggtcgcattcatgaacgggtttattaaaacatatcagcaaatggaaaaggagtccgatgaacgatgaatacagttttagttattggtgcaacttcgccaactgcccaggccttcattaaattaatggaacgtgattatccagaaatgactttaaaattatttgttcgtaatcgcaaaaaggtcccggcctatcagaaacgagaacatgttatttttctgggagatgcagcgaaatatactgattatgtagcggcactcgaggatgtcgattatatttatgattccgttggtgggctgagcactggtccgtacgttaagttattgttacgtgcaattaaggaaacacaggcaacaattaaacgaatagtcgatatttcggcaggcggtatttacggtgaatatttgtctggtaatttaccctatttatcggctgttcgcacgcaacatcctcagtatacccatgatcagttagacaaaccgttgttatttgcaaatagtggtattccctttacaatctttagaccaggactaattcagaatggacccgaaacaaaaattattacgcacggtcctgaatttagagcgataccggagtctgaatttgcaattaatcgagatacgtttgctagggcagcagccaatgccttatttaatgatgactaccacaatcaaagtgttgctatttctaatggtgaactattatagaggagaaacttttgtatgaagcgtttagttggaactctgtgcggtattattagtgccgctttatttgggctaggtggaatactagcacagcctttgttaagtgagcaagttctgactccgcaacagattgtattgttacggctgttaatcggtggggcaatgttgttgctatatcgtaacttgtttttcaagcaggctagaaaaagcacgaaaaagatttggacacattggcgaattttaacacgaattatgatatacggcatcgccggcttgtgcacggcacaaattgcctttttttctgcgattaattacagtaatgcagcagttgcaactgtctttcagtccactagtccgtttattctgcttgtatttaccgcgctgaaagcgaaaagacttcccagtttattagcaggaatgagcttaataagcgcattgatgggaatctggcttattgttgaatccggatttaagaccggattaataaaaccggaagcaattatttttggcctgattgcggctatcggggttatcttatacaccaaactacctgttccattgttaaaccaaattgccgcagtggatattttgggatgggcactagttattggcggtgtgatagcgttgattcacacaccgttaccaaatttagttagattttcaaaaacgcagcttttagcggttcttatcattgttattctagccaccgttgttgcgtatgatctttatttagaaagtttaaagctaatagacggatttctggcaactatgactggactatttgaaccaataagttccgtactttttggcatgttattcttgcaccaaatcttggttcctcaggccttggttggtattatattggttgtgggtgcaattatgatactgaatttacctcaccatatcacggcacctgttcccagcaaaccctgtcaatgtacgatgcctaatcagtagggaatgataagcaatcaataatatcaaaagtactggctttaacaacatattgaagaaatactgccaattaaaacatcggtactgcgattaccttttcgtaatcatataaagctattgttttttgaaagttgggtcattgagcacagtaattgattgtttcagttttagaaattgattcttagcaggtcgcatttttgaaatgtcttaacaaacgactaagttaaatttcacaaatggctgtagcacctataattgcacgctgtgctaaaaactgcgcgtatgtatggataaacattgagatttcaacgcaaaaataaagcggttgcatttccgcacgtctttcgctagagtggaatagtaaacctaaaatgaccaagtttcagatggtcaagcggatgagagggaactttaatatgtataaaatgattgtttgtgacttggatgagaccctgatgaatgacaatggtacgttgtcagaaaagaatgcggcggcaattcaagctgcggcggctaagggtgtttattttgtgccgaattctggtcgtagttatacctcgtttcagaacgatttggagacgatggggttgcgggaccaaccacatcaatattcgatttcttataatggtggtttgattttagagaataaggataatcggccattggcggtgaatgccatgccatatgaggttgctaaaggggtgtttgaagcgggaattgcgaatcagcaggcggcgacgcatgtgtacacgcaggatacgttatatatttacaatccggttccaagtgattcagattatctacaaaaccggggcgtgacgttcacaactatgacgacgccggactttgaacaattcaaaacgatgaacgtcatgaagattattatggccttgccaacgatgactgaccgcaagcaaatgcgcgcagacgttgaagctattgttgatccaagcaaattagccgtcacttattcgtccgaccgttacgttgagtttaatccggctggcgttgacaaggggaccgcagcggttcaattaggaaagctactgggaattacggcggatgaaattattgcagctggcgataacagcaatgatctccccatgctgaaggcggtcggattgcctgtgagtgtcgccaatggtatcgatgcagtcaaggccgcagctaagtacgtgacggtcgctgataacaaccatgacgcgttagcagaggttattaacaagtttattttatagtacaaattttatttagaaaatgaaagttgccatttggcgttcaacttttacaagtggtatcatgataattgaaaatgtggtagtatgaaataaattatttgttacaaattactgaatgggggaacacgcatgagtgcgattcgcgacgatttagctaaagcgattaagaataccaacctcgttgaaatctattccaagggaaccaatgagcaatttagtgttggctatgtgattcagcaggatgagaagtttgtgctggtccaagccgttaatgtcgatggtgaactagatgggttagtggtctttcgtaaggcatcgttagcccgcgtaattagtgacactgattatttgaagagcatggcgacgatcattgcgctggctaagcaacggggctattatgatgtttggaacactgaacgattgatgaataagctgctgaagaagcagaataagactaaacattcgctcttaaaaacattgttgaagcaagcttttcaccacgatcaagtgattcagctatctggtcgaatcaaaaaacatggtgacagctatgctggctttattcatagtgaacataagaaatatattgaatttaattacgttgatatgttcgatcttgcaaagcgcccacaaattgctattcgctacgctgaaattgatgaagccagtttccatagttttgaaacctttaatacaaccgcggttatcgagagttttatgccgggtgattttcactaataatgatctgtgagcggcaccgttaatgaacgggggtcgctttttttataccgtcgatcatgtgtgtcttttaagacaataaaggcgtgtatagcaagctttggagacggttacgggtattaattggtcagtcagcgatttggtaaagattgttaagtttttatcgcacaaatatacaaactggccgtatttcgctacaatggtagtattgagcatcatgcggggaggggagcagttatcgtttacgtctattggtatattgcagcttttgaccattggtactcggtcatgttggtttttttactgcagatattaatcaatcgtgagcttcgacagaagcgagtctatgcgactgttgcggttatgaccgtacttctaactgtgatctacatgttgtatgacgactatttggatatcatcacgttcattgtgaacatggggttactggcgtttgtacggcgcaaaaagtactttattgtgacgagtctaacggccacactcgcctacattctttttagtttctttggcaattatgcgacggagtcgatttttcacttatttaacttgggtttgaatgactggagtggctggctatttgaagccatcggtgaaacaattgtcacagcttgtatgttggcagtcgccgctagtttcaaggtcttaaagaagcgttatccgcggcaatttgtagacgggctaacgttgaacgtgattgtcagtgctttggctgtagttgcggtcgcgttttttaccatcacgactgcggcggataattataatattggctcaggatttttggggattctaatgttgattctagtggctatcttgctgatcaacgccggaacgtttctttacctgttctatagttatacattgcgggttcaaaataaccggcaagttttggaacggcaacaatatgatatttatgtcaaaaatttggaaaatagttatcaaaatttacgtaagtttcgccatgattatcaaaacatcttactgtccttgggtgagtatattcagacagctgatgatcctgaattacaacaatattttcgtcaagttgtgaccaagtctaagcaaagtctaaatcgtgattttggacactttgacaatttagaacaaatcaaggacaaaccattgaaagccattattcagagtaagttttccgttgcgcgccaagctggaattcaagtacgcttggaagccaacgacccgattgcggcaattgcaattgattcagtgacgttatcacgggtgagtggcatcttgttagacaatgccatcgaagcggtgaagggtcagagtggtggtcagattgcggtcgcacttgttaagtatccccgcatggtggagttgatttttgccaattcattgaatcatccgattgagcgcctggatgagctgatggttgctgggcatacttcgaaaggtgctggtcatgggcaagggttagcaaccgttcgtgagttgttagatccattagctaacgtgacttatgaagtgagctcccatcaacgattcgaatttattattagtattgaaagtgagtgagcagcgtgttaaagacctttgttgtggaagacgatcctgaacaattagcaaccttaaagcaaatcattaagaatcatattatgattaatgattttgatatggaactgaccttagcaaccggacaagcacaaacgttgttggactatgtcgagaccaattccgatcttgagggactctactttttagatattgaatatcctgggcaagacttaaatggcctagcactggcgactcgaattcgcgaggcggatgttaatgcgcggattgtcttcgtgtcgacccattctgaaatggcctttttgacctttgaacgacgaatcgaaccactggactttattgtgaaagatttgggtcaagaaacggtcaaagccaaagtggagacagatattcgggttgcttatgaacgttataccaagcaagcagtcaccagcaaggccatgttttcttactctaagggtggtcagctcttcaatgttccattagatcaggtgttatttatcgagactggagcagttcgtaataagctggttctccatttaacagatcgaattgttcaatacaatggtaagattagtgatgaaaccgtggcccacccagagttattccgggttcataagagtttcttggtgaacccgcaaatgctagtacgaattgataagcaacatcagcttggctactttgaaaatggcgagtcggtcgatattgcgattcgtaaaatgcatgatttaatcgcattaatcaagcgttccgaactggcagtcacgtttagctagcttcgcttaagactctaatgtaacaaaatcgttaatcaaaagtgaattttaatgacgttggtgcaggctattatgagctttgcaccttttttggctttttagattaatttgcatgtatgcttagactattaaatgccagctgtgggagctggtctggaggtggcgtcatgaagcagttctggtcactaatcttaatgattttggccggttgtttgttaatatttggttcggaatacagcttgcaaggtgattatcatcgacgaattcatcggctcactgtgtcaaaggtggtttaccatcaaaatgctacctctgcaacaatcagtggccgtaccaagcacggtgtcattgtcaccttaaagagtgggaaacatgtccgtcaggttatttcaaataagcagagtggtcaattctatgttaaaatgccagttcataagcggattacaattaaagtcgtggggctaaaagccaaagtactaacagtaccaaccgggacaaagagttagatgggtgagcgggcaagttgccggctcttttttgatggttaatgactaggacagcgtgccatataaaagctacggtgaactactcgaatttatttagttgttagtcgcgttacggggttgctaaaaaatcattaagcttctagttttgcgctaggcgcattgttgattttagcgtacagtaacaatgacaagaaaaggagtcgtggctgtatgttagtggttggcattattttggtgattggaatcatcgggacactggttttacgatttcaatttcactttcgcctcgcgatgggcaccattaccgagacggcgtttgcctgctcattgttgaatatcggggtatttttgttgtttattttattgggtcagttaacgggaccaatcctgctatcagaatgggcctacttgccgatttatcggttgttacaaggaggtttgattcccgttattggcattggcttggcaattctgggaatggtgcgtgagaaaggcctgatgaattggtggctattacattttaatgtgctatttttgatttttgacgtgttattagtctggcaggggagttataaaagttagggtggccagtgccgtgacgaagttgtgcgtgaaggtcgtcaatgcagtaacatgatggtaattgctaggctattgatcacaaagtggagcgcaatggccgcgcgaattttacgggtcagccgataaacaatagctagcacgagtcccatggtgacgtatatgaggaagctcggtaaggttgaactactatggaggctaccgaaaacaatcccgctgagcccgaccttgagccattcttgttgaaagaaaaggttagtcagaacgccacgaaaaactaactcttcaacaattggagtcaaaaaaacggcgctcaacgccataagccaaagcgacagaggactgccggccattaaatttttaatggcggcgttattttgtgtttgattctggtgatacagaagctggtttataaattgaaagccgccctcaaaaattaagatggtgagataggccattccaataatttgccagtcatggtattgtaagttttctgattgatagttgccggtatagtgccgcattagggcggttgccgccagtgctaggatcacaaaaattaacagatagacacctgccagggtgatctgccaggctgtgagctgatgctggcgatataattggttaattaatttaagtaacattggtgggatcacgaccccaacaattaggccagcagtgagcaacacgcgtccgagccaccccaagccgcggtcaataatttccatcggacttcacctcccatggttgattttaccgcagtgttcaggtttcgacacggatttgcaaatctgagaaaggcatcgatgccaggcacaagcggatgatattaatctggttgaatgctaaaaatataataattgtagaaataatggttgatgctctataaaaataaagaataaaaaagcataattcggacaaatcttcacactttcttcacaattatgtaatagtatatacttgtacctaatagttatacacttgttcattttactcccccaaagtggatggacgagcaagtacaatcccccatattgtacttaaacctaactctttggccctactgctactaagcggtagagtcatttttttgttgcacgtccccaaagtcaccgaatacagtacctgcaaaaaatcgtcccttaatacatacttaaattatttttagcggtctaaactatcaaattcaactgggttttatcatttgatttattttttgcggaattaatgtggctgcaaacacccataattatttgatcggtgctagctaacgatcgttcatattagccttgaacgggctagtctcaaaacaaagtgacgctagtgtcaaaaatcaattggtttaatcgcaacaaaaaaggccgaggttagaaaaacctcgacctagttaagcagtcagttagaatgcttcgccagaatagtcgacctttttaggatcggcatttttgatgtgttcggaagcaaagttaaccgtttcgcgaatctggttataggttgcttcatctaaaccaagtaaatccatgcaagaattaacgtgggcaaaaatctctggtttagcatcgatggctttttgcgacaacgagatgttgacttggcgttcatcgtccgtatcgcgcttgcgttcgacccagccttgggtttgcatccgtttcaataacggggtcagagtcccgctatcaaggttaacgtgtgaaccaagttcccggaccgtcatcggactcttttcccagagtgccaataaagtgatgtactgcggataagtcagcttgaaaggtgctaaagcttcggaataaaaatgattatatcgtttgctggcggtgtagagcgcaaaacagagctgttcgtcgagcaaaatgttttttgttggggttgccatcaaaccgcctcctttactatctattttagtacattgtacgcaattaattcgccaaatgcaattaatattgcgcaaatacattgttttcgaacgatttatttataaaagcgggttaattaattgacctgttggcgttgttgggacttaatgcatgtcaggaataactgggccatggcctgctgattgatggcaagttgatggttgtccgtgaacgcataaagtggaacttgtgctggcaatgttttggccgcgtgatcaccaactggaatcaggcaggcgatttttgttttgtcatgtacaaattcatgagcgtcacgtggggcggccttaatcgtcagtgatgccaatacgtgataaccggtcggcatcatgtgttgtgcatgtttgacatgcaccccgtgtagtcgggaacgtaactggaacccagacgtggtggtcaactgtaacgcttgctttaattccaataaataagtttgttgattatcaatatttttcaaccggatcttgaagtgtccgaatggaatggcgcgatcctgatgttggacggctaaggcgtgttgttcgacccgcattttatccttaacgggctcaaaggtatattgttgtaaaagttgtgttgctgttttcaaactatcactccctacgattaatttagtcctttaaaaacttgtggtcaaataattggttacgtttgcgagtgacgtcgttttcaagtaaaattaaagtgatagggggttggaaaaatgtttatgacaactggtgatttacagcgctcccatatgattaagggcgtcgtctccgtcacaaaacacctgatgtttgaatctgatggtgttgatcagtttgaacggtttgacgatttaatcaaacaagtcaagccactactgctacaaaaggcagaggatcaaggtggcgacgggttaatttatgtgaacttcaatactgaagtcgctcagatgagtgttgcaccacgatttttgatcgtaaccggctatgggacggtcgtcaagctcgttgatgaatcagtctgatacttaggatctgaattttcaggtccttttttgatagcaaacaagtgatagaaaggaaggtttgatgaccagttattcatttccacatggcgccattgacgtatacgacgctacccaaaacaatttaaagcacgttagtcttcgcgttcctaaatatgcaaccacggtgttcgtgggcttgtcaggttccggtaagtcgtcactcgtttttgatacgattgcagcggcgtcacggcgcgaactgaatgaaacgtttcccagttttacgcaacaatatttaccgaagtatggtcaaccacacgtcgggcatatcgagcacttgcccgttgcgattgtgattgctcaacaacgcctcggcaagaatgcgcgttcaaccttggcaacctatactgggatttattcgttactgcggctcttgttttcacgggttggggaaccgtttatcgggtattcggacagtttttcgtttaacttaccccaaggcatgtgcccaacctgccaaggtttaggttatgttgacgatattgatgagcagcaattgattgatcctgagaaatcattaaatgagggggccatcacgtttgtgagttttgcaccggatacgtggcgttggcgccgttatgcgacgagtggtttgtttgacaatgataaacccatcaaggattatagtgctgcggaatacgatttactgatgcacgcaccgcaacagaaattagcccatcctggagaaggttttcctagaacggccctgtatgaaggtgttgttccgcggatcaagcgctcgattattggtaagaaggaagccgaacaccatcgcgatgcgattgcggcgatcgtcacgcgcaaaccgtgcccaacgtgtgatggcacacgactcaaaccggtcgtgttgaccaatcatattaacggggtcaacattgctcaggtgacggctatggatttaaagcatgttctggcatttttacaagcgattgatgcgccgttagcccaagatattgtgcgggagctgacgaccaagatccaatcgttggtcgatattggcctgggctatctgacattggatcgtgggaccagttctttatctggtggtgaagcgcaacggattaagattgccaaatacttgaccagcgccttagtagatatggtctacattttggacgagccaagcgttgggctgcacccacatgatattcagttaatcaagcaagcgttaacgaagctgaaggataagggtaacacaattctgattgttgaacacaatccagccatgtttacgttagccgactatgttgtcgagatggggcctgcagctggtcgcactggtggaaacgtgacctttaccgggacttatgacgagttactggcttctgatacgttgacgggccggtggttgcgacaaccgcataaatggggtcaagaacgaccagtccaggcccacttggcattacaccatattaatgaaaataacctgcacgatgtcagtgtcgacatgcccctcggtgtgatgacggtcgtctcgggggtggccggttcagggaagagttcgctggttaccgcgctaaaacggcaattaaagacggcttatattgatttagcccagacaccagtgggcctgaatattcgctcaacaccggcgacttacttaggagtgctcgaccaaatccgacaactattcgcgaaagccaatggcgtggcaactagttggttcagctataatggtaagggtgcttgtccgcggtgtaagggtaaaggcgtgaccatcacgaatatggcctttatggatcccgttgtgcagacatgtgaattgtgtcatgggctgcggtataatgaaacggcgctcagctatgcttaccagggtaagacgattgccgacgtgctccagatgtcagtcacagcggcgttagctttttttgccacgatggacaaagtggctcagccattgaagaatttagaccgggtcggtttgggttacctaacattggcgcaactgctcaccactttgtcgggtggtgaactgcaacggttgaagctggcggttgagctaggcaagcagggaacggtgtacttgttagatgaaccgactgccggtctgcatttgcaagacacacaacgcttattaaaattattcgatgccttagtggccgctggtaactcgttgattattatcgaacataatctggcggtaattagccaggccgattggttgatcgatgtggggccggatgctggtcagtatggcggccgaattcagtatagcggaaccccacgagcagcagttgacgtgcccacttcacgcactggagccgctttgaaggcttggctgaaggcgtgattagaaaatttgattaaataaaaagcacgtgcaattgcacgtgcttttttagaagggcggtaggtgggaatcgaacccacgcgtgccggagccacaatccggtgcgttaaccacttcgccactaccgccatcacgttaacttttcgtcaacatatctagtatacactaaaatcgtgggttgcataggactttttgtggattttcagaaattaatcgcctcagtttctgaagcgttggtgaaggttctactgtgaccaacaattatttaaccgttagtaaaaggccatagttcccctaacaatgggagctacggcccgtttgccgtggttagtgtgtctaacggataggtgaggtggaccagcacttatcggttgagcaaaattattatgaattcatccttattgaagaaatgcgtaaaaatctttgcaaaggcactactttgttaaaattcacaaaataaaagagcccagtaaataagtgtttaccgtggctcttttattgctcatagactaattatgccccaggcaggattcgaacctgtacattgtttccaatacagcgacctgaacgctgcgcgtctgccagttccgccactggggcagttgctttaacaacaatatccattatagcgaaaagtaacaaaaaaataaacctttttctatatttatgcagttgatattaattgtaattgcaaattggttgcttagttactggggctggccttaattagcatggaataactgtacgccgaaatactgaaattactaccggcaaaaaatgcatccaaaaagtcacccatcccagcaggttcaacgacactgcttgaatgggtgacaacttgtcggtttattaatttgcttgtttggtcgtgatactaccatctaaataaacaaagtaactattcagataatgcccccggccgccattagccgttttctgataagcatcgacctgataatagtggtggccgtgtgcatcttgattggcagttggtacgacaccaaaggtttgttgcttgggatcgttgagcacttgcccgacggcggccactgcactagttgcgctagtgatatggtcgtcagcagcttgataatggtcaccagattgcttcttagcactagcatcagccgctgcattggcacgactagtttgctccgcgcggttagcggctgcaactgagttcgcttgcttagtggaaatacttggctcagcttgggaagtgcagcctgctaaaaggaatagggcgcagaaactgattaaaattgcccgggtcacgttcggacctccttatttcgtttgttcttgggacaagctcggataaggggcttgtcggatgatgttcgaatcaacgatggtcatcacaccgattgacagaagtaacaggatcactaagattaattttttcattaaaataacctcacttgataacggtgattgacctatttccagttagggacccaaatgacgcggtcaatttgttcaggaatgaccgtaatcttggacccagtctgtggcccagcttggacgtcgatcacatatgagatcggaccagcatcgacttcaacaatcgagccacgttgaccgtcgactgtgtcgactaaactatacaatggaatctcatcattgctgatttccatttcatataaggtgaattggaggaagtaggactttttaccggtcttgatttttaagggggtgtcaatggcaccgtaatcgggaagggcccgattttgagcgttgggatcattcaggtactgcatttcatcgacagcatcgatcgccatcttccattcaccaccagttaaattagttttggaggagagggtcatgaccgagttagcgtaaatgtcgatcacgttgaaggcttcgtcgacctgctttttcggcagatagccgatggtatagccatgctccgcaacttttagttcaacccgtacggatcgctcagcaccatcaacttcttcaactaactgaatttcaccgatgttagcgttagcgtcgacacggtacttcttggcatagagataatctgctttcagaccagaatcattatagccaccataaggtttaaagtaacctcgggcactcgcatcggccagcgcggcttcaaattctttttggtagtaatctaaaccaatgacgtatgagcggaaaattgcacgcgaattagcgttgatccggcgcgtctgaggaaccgccaccggatggggaacggcttgattcaagcgattccgaaaaccgttattttgagtctgcaacttggtaatttgacggtcttgttcctgattggtcaaagtttgatgaacgaggcgctgccgaattgatttaagcaacgcggcctgtttatccgccgcctgattgacatggtggagatggactaacaccgcaattaagataatgattaaaattagacaggctaagatcagcccggcaataaataaataagttctcataaataattcactccaaaaagaattgcagattagtttaagtataagcgaccagcccactaagcgccaatttaacggctgagcttgtcagggggccgataacaaggtatgatattgctattgtataatatttttgagctagaagaaacggtggcgaacggcgtgcagtggttgattaaaatctaccatcaatatcaatatttttggaaatacgcactgtttggctttatggccgcgctggtgaacgtcttggtattctgggtgctacactcagtcttggcggaacactatttattttccaacacaatcgcatgggtgctagcaactttgtttagtttttttaccaacaaagcggtggtctttcagtccaaatcgcaagacttttggcactggtgtcgcgagttcattagtttcatgttgacacgaggcttatcatattttttcgatactttcctcatgttcgtcggcatttcgttgttgttctgggcacccctacttgttaaaatcatcgaccaggttctcgtgggactctttaactatgggacgtcgcggctgatttttatggaaagcaaccagaaaatgcgaatgcgccagcaaatcatgaaacgtttgagtgatcgtaacaattaattggcatcaggcaagcaagtcgtcccctaacggacgacttgttttttttgatagcatcactttggatcgttaggcagtaatttcaacgacattgatggtttaaatcaagtttcccgtcaattgccagtgcaagccgatgccacaaataatcgttagtaaggtgccgcagacgagtagggtgacaagtccagagttcaaatgactttcctgcttgcgggcaaaggccacttcaatgaggccaatcgtgccaagaccgagtatcacttttagcaaggtcaaccaccagttgcctgataaggttctgattgccaaggccaccccagtgatgataattagcaggtacccgatgcgactaagaatcaaaaagcgattggctgatttgactgagtgacgactgagaccaatcgcaaccgtcagcatgagccatagccaaccaataatgtgccctaataagtacatgacaaaaccgcctccacatttacaattcatgtctaattttagcatgaaagtaggtgttggcggcggtttcttttattgtactttaattaagtttttctgttggatgtaatcgactaattcaatgaccgttttaaagcggttaaacggtgtgacgatgtgaacgccgttgaagcgcgcacagataccatcaatcaattcctttgcaatagcaatgcccactgcccgttcgtttccggtctgttcggcttctgccatgcgtgtcaagataggctctggaatccgaatgccatggatttcatggtgtagaaattcagcattacgccgtgagacgagtggcataacaccaacgaacactggcacattcacgtgattagccgctagagcatccgccaaagcgtcaacgtttgcaagatcatacacgggttgggtgataatgtagtcacaaccataacttaacttccgactgattgacttggtcgatatggaagtgcgataagcgttaggattaaaggcgcctgcgacccgaaagtcactggcttctttaagcgacttacccgttggtccgatgccgctattgaattgcttgatcaacttcatcagttcaacggagcgcacatcgctgaccgaagtggctcccggaaaatcaccgagtttggccggatcgccagtgatagctaagatgtcctcaatacccaggctgtgtagacccatgatctctgattgtaagccgattagattgtggtcgcgggtcgtcaagtgaacgatcggcgtgatgccgtagttcaacttgagctgcgccgcaatcgtcgtattagcaatccggaccgttgctaacgaattgtcagacagtgtaatgccatcgacaccagcggcttttaatcgttcagcaccccggaaaaatttagtcgtatcaaaatcgcggggtggatcgagttcgactaacgccgttttttgggtcgcaactttttgcagaaaccggtgctgactctttgtcgtgacgagcgttggtggctgtggttttgtagccggctggtcatgagcaacgatgctgcgattacttagtccgcggacggttgcgctggtatgcaaaggtgtggtcccacaacaaccaccaataatgttcagaccgagctgacgaaagcgttcggcatattcttcgaaatagcttggttcaccatcgtagaccaccgcaccgtcctgatcagtgccaggcaagccagcgtttgggtaaacggctagtttaacgttagctggaatcgccaagttttcaaatgactgagctaaatagtaaggtcccaggcgacagttcatgccgattacgtcggcgccggcagcgttgagttggacgatggcatcagtgaagctcgtaccgtttcgtaagacgccgggggctaacattgaaacattcgtgatgacgggcaagtcagtatgggccttcacgatttttaacgcggcgagcagttctggcaaatcataatatgtttcgagcaagatgccatctaactggttggtggctagaagggcggtaagttgttcagtcacgctggcagcaatcgttgctggtgtcgcccgttgaacagttgcatcggtatcgccggctagtccaccgatcgttcccagaatgtaaacggggtgatccgcgtgttcccgtgcggtcgctgcaattttcacagcggcctgattgatggtggtgacttggtcttgtaaatcataccgggtcaactttaggcggttcgcagcgtaggtgttggtttgaataatatcggcaccagcccgaatgtacgatcggtgaacgcgtaagatcgtgtcgggatgcgtcaaattcaggttttcaaaagccgaattgatgccatagttaccatataaaagggtgcccattgcgccatcggcaacgaggacccgttgctggagtgcttgtttaaacttcattcaagccacctccttagtggatgctagtggtcaattgggcctggatcgcgttgcgcgcagcaatcatgttctttaaggctgctagggtttctgattcttgccgggttttgagaccacagtcaggattgatccagaattgccgggcgtcgataacgcgtaatgcgcgttggatgttggcttcaatttccgcaacactcggtacgcgtggactgtgaatgtcatagacccccagaccgatttcttgatcgtacccggtttgttcaaaagcactgataatctccccatggctacgggacgtttcaatcgaaatgacatctgcgtcaagggctttgatggtatcgatgatatcggcaaagttagagtagcacatatgggtatgaatctgagtgtcgttttgcacgccggtcgtggtgatcttaaatgagtacactgcttcatccaaataggcttgccaatggcgctgcttgagtggcaaaccttccctaagtgctggttcatcaacttgaataatcttaataccagctttttccaagttttgaacttcttgccggagggccaaagcaatctgattttgaacctgcgccctagggatatcgtcgcgaacaaaactccagttgataatggtcagtggtgctgtcaacatgcctttaaccggctggtcggttagactttgcgcgtaaacggactcagcaacggtgattggttccgtgtaagcgacatccccaaagataacgggtggccggacgcctcgtgaaccgtatgattggacccaaccattttgggtcgcatagaagccagtcagtttttgaccaaagtattcgaccatgtcagtgcgttcaaattcaccgtgaaccaggacgtcgaggccgaggtcttcttgtagcttgatccatcgtttggtttcagcatgcaggaatgcctggtaatcggcatcggttaaattacccttgcgccatgctgctcgttttgctcggacttgcgcactttgcggaaagctcccaatcgttgttgttggcaggaagggtaggtgtaaccggtcgtgttgtaacttaatccgggtcgcaaatggtgcctggcgttcgaatttttgattactcagttgcgcttcagcggcgcgaaccgactggttgttgcggtgactggactggttgagggcagtcaagttggcctgattatggtcgaacactgcttgaacagcggcaaccccctgattggctgccacggttaaggtatgcagttctgccaatttctggtccgcaaaggccaggccgcccagtaagacggggtcagccttggtttcatttttggtggtaatgggaacgtgtaataatgagttggcgggttggagccataactgatcatcggtcacgatttgccgtaactgctgaactaatgcaagttttgcttgtagatcactagcccagacgttatgtccatcaataatgccagctgcgagaattttgtcggttgggaagccgtggtcgaccaagtgcgccaggttttcaccatggtcgtgtactaggtccagtccaagtgcttggattggccaggtcacgatttggtcgtactgatcaaggctgtcaaaataagtttggagttcgatttttaaggatgggacagccgcatgcaaatgttcaagtgcagtttgataaggtgcgagttccgcaaccgtcgttgttttgactagggtcggttcatccaattgaatccattttgcgccagctgtcgctaattcttcaaacacttgttggtaaagcggtaataactgcggtaatagttcgttgacggcggcgtcatccaagtactgtccgtgacgtttacccagtttaaggaaagagatgggacccagaatgactggtttaccatcaatgcctagttcttgcttagcttcttggtagtagcgtagccagcgattatctaataacttaaaggacacgtcatcgaattcaggaacaatgtagtgatagttgatattgaaccactttgtcatttcggccgccacggcggtatcagttccacgggcaattgcatagtagtcgggcaagtccaactggtgatcgaagtgaccaaagcgacttggaatcgcgttgaatgcgactagtgtatctaaaacgtgatcgtaatccgaattgtcagcgaccggaatatagtccactcccaggtcgcgttgctttttcaagttagctaggcgtaattttttagcagtggcgtgaaaggtcacgttgtctaattgtcctttccaaaagtgttccaataagtgcttccattcacgatgttcacctaaacgtggataccccaagttactattaataattgtcattaaaacccactccttatatttagcaaattattttaaacgaaaaaacggcaacctcatcctgattaaaggacgaagttgccgttcgcggtaccaccttaatttgtcaacacctcacgatattgacctcaatccgtacgtttcatacggaagcttattaacagtagctaactgtcatcacctggcaaaagctcagtggtgccgtttggaggccatttttcatcaatcgtcttccggtttggtttgcactattccaaactcactgcacgggtagcgatgattactttcctcttcaggacgtttacatgttttatgattgattagaaaataccaccaatttctaatttagtcaaattattttttaatcttttgaacatattcaaggcgtaatgtgacgcacacgctatttggagccaggcaagtaggaaacgtggtgtgaacagccactagtatttgccagcaaccgttgtcggattccgaccgcttgaactggtgaatagggttgaaacgcagctcccacatggttgggttgacattttaggtcttcataacaggggcgttgcgccaagcattcaattgaggattaagttggttaagggtgctgacgatattgagtgaaatcaggtgctttggtaatcaatgcactggtataaagggattttaatagtcctaaaatttgaatatttcatcaaaactgtggggaaatgtcctaatctacacccagcagattaccgggtgcgtacttgctaaaagcactaaatttcatgaaatcatcatatttttttcgagttaagagtacttattttcacaattaacttgctagtatatttggtgagcccactagcgaagtaccaaagatcaaataaataataatgattaggatgatgaagaatgagtcaaagcttatggcaacgattgtttaatcaccgtcaacaaacgaagcaggccgtattaattcttgggagtggccgttccggaacatcggtaatgactaagtgtgttaatttgatgggcatttctctcgggactgataacctgttggcacctagtaagcggatcaatccgaaaggctattttgaaaataaagatgtcatcaatattcacaagtcacttggaagtcgcatccggtaccggccagccttcaagggttactatgatagcccgaagattaaaaaggaccgggcggcgttaaccacgtatctacgaaatttttttgagaatgaacagtatctggcgataaaagacccacggatgaatgattatatcgaattgtggcaacgtgttttggctgacgttgaggttcagccggctgagatcgtcttgctacgtaatccgatggacgtggtcaattcgaatgagcgcgcctggcaccgtgataccacgctcgcaatgcgtcagtggcaagtccggacgttgctttcattacgtgataccgaccgtgagcaccgcattttagtcacgtacgaagatttgtttggtcagacgttgacgacgttgaaacgaatcgcgacccaatttaacttaccgtggacgagcgacgaggcggcactccaagcgcaaatcgatgacttcatcgatccagcactccaaaagagtgatagcggtgaaaatttagctgattttgaagctcgaacggacgtgaaaaccgatgttaaggcactttacttactaggccgtcaagctgcggctgacccggattactttgcctcggctgaatttcaacagcgcatcgacgagatgactgacgagtatttagccaagtatggcgctttatatcgggactttaacgtcaagatcaatagtaaaacgttctttgtattcggcgaagatcaggcccaagttgatcaggtcaacacgactttacgaaatgatcaagtcaagatggtcggcacagaagctgacagtcatgaggttgctgaagatttgagcgaacggttgaataataatacgattgccattcagacgtaccccttggactatttagtggtcgagcaaaaggaagccctgaacaattatctccgtaaaaacgcgaaacgcgagacgttatgggggattggggatgctaaaaacaatgaaatcgttgaaatgttaacgacggtcagtgccgagttaggtgcggatacgcataacgtggtgattgcagatgacttaacggccatcactgatgaacgtgagcgccgattagcgattcaacatttaatacggacgttgcacgcggttgaacagccaccatacttggtcctgatggctgacgaactgggaacccctgcgtcgcaaagtgcggtgacggcttttattgctgctgagccgaccaaggcagcgccattacgagatgaacagccggacgaaacgttcaagctgcggaccccgctagacatggatgaggtggcggcaactttaacagcgttgtgtcgacgtgcgagtcaggatgaacaacagcaagccgcattgaaccattttgtaagtcttaattatgatgaaattttaaacgtgaaaggtgatcaatatgcaaacagtgtacggaattaaagctcatggtggtaagttagttaatttagaagattttagtgaagcaacgcgtcaggctgctgagcagctgccaagtttaaccatcaataattggaatatctcagacttggaattaattgggattggtggttttagccccctgactggcttcatggtcagtgatgattaccattcagtggtcaacacgatgcacttgaagagtagcgttatctggagtgtaccaattacgctgggtgtgtcccaagcggatgctgataagattgaattgaatactaagattgctttgaagggcgctgacggcgtcatttatggcacgatgcaagttgaagataagtttgttccggacaagcaattggaagcccaaaacgtctacaagaccaccgacgaagcccatccaggtgttaaacgcttgtatgccaatggtgacgtctacttgggtggcgcaattaaattgttgcataagccagatcatggtgcttttagtgattattatatggaaccattagaaactcggaagatgttccatgacctcggctggaagcggatcgttgggttccagacacggaatccaattcatcgggcgcatgaatatattcaaaaattagctttggaaaacgtcgatgggttattcttaaatccattggttggtgagaccaaggcggatgatattccagcagacgttcggatggaaagctataagacaattctgaagtattactatccagaagaccgtgttcggttggtcatttatccagccgcgatgcggtatgctggtcctaaggaagccatcttacacgcaatcgttcgtaaaaactatggttgtactgactttatcgtcggtcgtgaccatgctggtgtgggtgactattacgggacctatgaagcccaagaattaatcacttcggtcgaagatgagatgggcatgcacttcttcaaattcgataattccttctactgcaaaaagtgtggttcaatggcaacgcagaagacttgtccacacggtgccgaagatcacatctcattaagcgggacgaaggtgcgtaagatgctggctgatggtgttgtaccaccaaaggaagtttcacgtcccgaagttgcccgggttctcattgatgggttgaagcgtaaacgtgaacagcaacaggaggtctaagcatggtaaaatcagataatattacttggcatcaatcgcaagttagcaaggccgaacggcaagcgctgaaccatcataagagtgtggttttatggtttactggcctgtccggttccggtaagtcgacgattgcgaatgccgttgaaaaagcattatttgaccaacaagttggtagttacgttttagacggcgataatatgcgctttggcttgaataagaatttaggcttctcagctgaagaccgtgaagaaaatattcgccgaatcggcgaagttgccaaactatttgtcgatgctggcgtgattacgttgacagctttcatttcaccatatcggaccgaccgtgataaagtgcgggcgaaccttgaggtcgatgagtttattgaagtgttcgtcgacacgccgcttgaagtttgcgaacaacgagatgtgaaacaattgtacgcgaaggcgcgtcgtggtgaaatcacgggctttacaggcatcgatgcaccatacgaagcacctatcgatcctgagattacgattgacacgtccaaacaaccactgaccgcttccgtccaacaagtattgaattacttggcggaacatcattacgtaagtttggctactgcaaatgaaaactagtgcaatcattactgccatcacaaaatcgattgtgaaaatggaccgaatcttggtctatcgtcatacgaatccggatcccgatgcaatcggggcacaatttggactagtcgccttgctcaaagcggcttacccggagaaactcgttgtggcgatggccccagttccgggccatttggcgtggatcgatacaaccgatgagcagttagtgaccccccaagcaacggacttagtcattgccgtagattgtgctaaccatgagcgcctagctggggagttgccaacaggtgcctttgtgattaaaatcgaccatcacccgaatcacgatccctatgggcaactgaactgggtcgatgaaacttatagcagttgctcggagatgatttatgagttggcgcaagcggggtgctttacagtgacggcggccgttgcaaccaagctatatgccggaattatcggtgatacggtgcgcttttcaactcctgagacgtccactcgaactctgaagattgctagtgcactcgcggcaacggacattgatattgccactattagtcaccacgaaatggacttaacgccagcactcagcaagttgtatgggtacgtcctgagtgaacaaactattgagccaagtggtctggcacacgttgtcttaccgcaacggctatttagtgacttgagtctggaatgtggcgatgaggatgcgcttgtcccgttgcccggtaacctgacgacggtcaaagtttggttgttcttcattgaaaccccacaggggcaataccgcgtacattttcggtcgaaagcaatcaatgtcaatgcggtcgcaaaagcgttcaatggcggcggtcatccgttagcaagtggggcatttgttcctgacctagcgacagttggacaagtcattgagcaaatgcaggcgcaaatattagctgcgacggccgtagattgagtataataaatttaatataaactgcactgattcggtttgacatggcaattgttagtcattctgtgtcggtcacgtgggttgccacgggaaggttagaccgccagtatcagcgtatgagcctaatattctggctgacaaaacgggtatgtcgttggagtagcggtcgtgaggaattaattggcgtcagacaaaatagtgagatagggtcggtgaaaggtaaatgaaaaagcgaaattggttgattgcactaattgtcgttgtgattgtcgcgattggcggtggttttgggtattacaaatatcatcagtcaactgcaacgacaacgaccactagtaaggtacgttcggcgagtgcaacgaagaaggacatcaacacgcggctagtcaagactgagattaaggcccagtcgagtgagacggcgacgctgaagaaggcggtcgccaataagaattataccgttaataacatgtacacgaaggttaacccatacggggtgtccccgttatccgctaaggtgattttccagacgagcaaggcggccaaggtcagttatacggtggtcggcaagagtagtaagacttcaatttctaatacggtcaataagtacacaacgagtcatgatttgaccgtgctggggttatacgccaacacgaataaccaggtcaagattaaggtgacttataaggatggcacgtcgacgaccaagacgatccgactgaaaacggcgaagttaccatcggcgttgaccgattttaagatcaacgttaagaaggctaacaaacaaaaaatggtcttagggactggtaattcgaagctgacatttatggttcggacgacgatctctgggagcaagcagtctaaaaacttatcgttcgggatggatgcggatggtaatattcggtggtatacaacgcggccaacttcccacattttcaaacaacttaacaatgggcatttattgatttggaccaaatcgaatgctaagaattcatattttgatgagttagttgaaatggattatacgggtaaagtttataagacttataaatttaatcataaggcctggggtaaggctaagggttctaagaagcagaaccataatcaggtccaccatgacgtaacggaattaccaaacggtgatctgattgcgaccgtttccgatggcggccggacctatgtcgaagacacgatgatcgttatatcgcataagacgggtaagatcaccaaggtcatcaacatgaagaatatcctacctgcgaagttctatacgaagtacgacgcgacgaagtccagtaaatatatgggtaagaaggactggtttcatcagaactccgtctattatgataagacggataagagcttgattatttcaagtcgcaaccagaacttagtgatgaagatcgattacaagactgaaaagatcaagtggatcttgtctggtaagaagacttcagcttggccgaaatcgtaccgcaagtacttgctgaaggctagtggtaagattgcttggccgggtgggcaacatgccgccatcgttgatccaagcaccttgggcaagaagaactcgctcaacgtgatgatcttcaacaataacgtggcagttggtacgaccaagaaatcgttggcggactcttctggtaaatattcagaaggtgtcgaatatcatattaatgaaaagacgaagacgatttctcaagttggcagttacggcaagtcattaggtaagaagaactttgccaatattattggttctaatcgttacttgagtgcttcgaatcggctaattgattttggttggttgaataatggtaaatcagctaatattattgaatacgatttgaagagcaagcaacaggtgtttaacgttgaattaacgggccttccaagcggtggttatgtctaccgggccgaacgcttctcgttgtatccgacgaagcacacgtatggtattaatgaataagaattgaatgtaaaacgggcgctcatgactagatggctcatctggtcgggggcgcctgtttgcgtgttgcgctaatcagtcacggccgttaacagattatagagagacagtcaggcattgtttttccccttgacaatccagttttggagcgtccgtctgacttcaatctgacctcaaccgtgcctgttcacaaaccaattgctagtccgaaaaggtcgttttcaaagttgtgactgaacgttaatgaaaaagtcacaatttggtcgcaaaatcatccgcaaagctagaataatttcataccatgtcgcatttatgttcacattccaagtctacaatggttcttatgttgaacggcgcgacggatataggttgattatgagcagtggcgcaagactcagcaagatgaaaattagttgaagcggagcgatgacgatgaccttaaatattgcaattgttttaatcacgttattagtatcatttatattaatggccatggaagttacgaccccgaacgccgtaatcttgtgtgccttagcgttcttgatgtttgtcggcatcttgtcgccaacggacgcactgtcaggttttgctaacgacgggttagcgacaattgccctgatgtatattattgcctatgccatcgccaaaagtaatattattacccacttatttgaccggattctcggcgatggtcacagcgaaaagcgttccttattacggttgttagcgagcgtgagtgtgatttcaccgtttatgaataataccccgattgtgtccactttgacaccgatggtccagcgttggacgaagcagaaagggatggcaatctcaaagttcttgatcccactatcctacgccacgattctgagtgggttgttgaccgttctagggacttcgaccaatctagtggcacaaggattattgtctaagtacaaattagcacaatttggtacctttgacttggccgtcatcgggattcccatcacgattattgggttgatttacttactgacgatcgggtaccgcatgttaccgacctattatgggagtagtgttgacgatgttgttgctgaaccgaatgattacttgattgaaatgacgatcggcgatgagtttgaacacctcaatcaaacggtggtcgccgccaaacttcgtaatttgccgcgctctttcttagtggcgattaatcggagtggtcagtcgatcgtgccggtgacggatgagacgattctacagttaggtgaccgtctttacttcactggaaattttgattgtattaatgatcttatgaatattaaaggtctaataccaagcactcagaaaatcaatatgactgatatcaccaatgaacgggttcggctcgtcgaagtctccattccggacacgtccagtttggtgaaccaaacggtcaaatcagcgcgttttcgcaatgtctttgggagtgtcgtcgtcgcaattcgacgcaacgatgtcaacctcgaagggcatctcggaagtattcgcttaaaaggcggggacaacttggtcatgattaccactggtgaaccagacgagctggcaagtctcaaagatttacacgtctttaattcacaaccagtgaagtcccggaaacatacttataaggatgttttaccgattgttttattggttgcaacgatcatcgtgtcgactatgggcgtgattgatttgttcgttggtctggcggcctcgtgcgtggtacttttcttgacgaaatgcgtttcaatcagcgatattgtgaaggctgtcgatatgaacgtgttgtttttagtggctagtagttatggacttgggcttgcgatgtcgaatgtgggtgctgataagtttatcgcaaagtcattagtagcaattaccgggaacgcatcaccaatcatctatatgttcctgatttatttcgtgactaacttcttaacggccattttgtccaatgcggcggcgttatcactgatgtttccagtggtcgtttccgcagcgaagttggaaaatctacccgtgatgatgtttgtgatgttgattacgattgctgcgacggcagacttttcaacgccaatcgggtaccaaacaaacttgattgtttacggccctggacattataagttcacggactactttaaagtcggaattccgttaaatttgatttgtatggtcgtttgtgtgtttgtgtcctattactattatatggtgctgtgatgtgacttaatcgaatctaaaagacttgtgagcgcctgctgacaagtttttttgtgttggttagtaaatcggtgacagcttagcacagtgaaataaccttaaaaagtaaatcaagacggccaattcactagggactgtctgaaaacnnnnnnnnnngtagttttaagacggaccctaattaaaataaaatatttaatatttgcgaacaaaggactagtattataaatctaaagttgatatactagcaaagtttgcttgtctggcaaagcaccaagaaaacgattacaagtacgtcatcttaattaatgaaaggagtgcgaaaatgaacgatttaacaaagggaaaaccgctaaaattaattttttggtttacgattccgttactaatcggtaacatttttcagcaattttatagtttatcggacacgttgatcgttggtcagacgttaggggttaaatccctagcggcggttggatcaactgggagtgttcagtttttgatcattggctttgcgcaggggttaaccgctggcttatccatattaacagcccaacattttggggcacgtgattttaaagcagtgcggcgcagttttgcgattagtatcgtagttagtctaattgttgggatcattttgacgattctgtcgttgatcttcgttgaccatatcttgttgttaatgcaaacgccaacggatatcattgcggatgcgcggacattcttacaaattatgcttggcgggatgctggcaccaattgcgttcaacctgttgtcaaacatcattcgcgcactcggtgatagtcgcacgcctttatggtttttgattatcagcgcgttaattaatattggcttggaattgttattcattttggttttcaaatggggcattgccggggcgagctgggcaaccattttagcacaaaccattgcaacgctcatgtgtgtggtttacatcatcgtcaaagtacccatcttgcacattggacggcgccacttcaagttagtttggtcggaagtgaaggctcacctgaatgttgggttacccatggcttttcagatgtcgatcattgcgattggaacgattgtgttacaagcggcactgaatagtcttggcactaattcagtggcggcgacgactgccgctcagaaaatcgaccaagtcgcgactcagccattaatgtcttttggggtcaccatggcgactttcgcggctcagaattatggtgctcatcagtatgaacggattatcacgggagtcaaacagaccatgtggctgtcggggagctttagtgtggctgccggtttgattgaaattatttggggtaaacagcttgtgggattcttcgtcggtcatcaggacatggcggtattgaacttatcccagacgtattttaacgtcatcgggagcacgtatatcctattatcaatgttatttattatgcgtaataccttgcaagggcttggacgcagcgcaattccaactttggcaggcgcggcggaactctttatgcgggtgtttgcagcgctgatcttagttcggatcttcgattacgccggtgcttgtagttcggaaccgttagcttggttagggtcgtgtgccgtgcttttgcctgcttatattaaatcagtccacgatttacgacaacaggcccgcatgacaaacacggtcgcagaaggggccgaaccaatattaaacgattctgaaaaattgtaattaaggcttgcaaccaagtggattatttgataatatttgttatcaattttattttaaagtcactcatataatctcccggacacctgtggacggggcatgaattgaaaaacgttaaggagtttacaaatggccgtagaattaaaaattggcgattacgtcgctggtaagaagtttgcttcgttggaacatgatttcaagggtgaaattgaaaaagtgtatgaaaattcagtcttgatcttaattaaggaatttcaaaaagctgacgaaccaattgttaacgagtataaccaccgcgcagttgttcgtaaggatgatgctaagctcattaaagcggctccaaagccgaaagtcgtcccagaaaaagaagactaaaaatttataaataaccatgacaacagaaaaaatgtatgctatactaatttctgttgtcaaatgcgggtgtagtttagtggtaaaattcaagcttcccaagcttgcgtcgcgggtccgattcccgtcacccgctttgctattaatcatttcggttagtagtcattgtattctcaagctccttgagcgcatggtccgttggtctagttggtttaggacgcctgcctgtcacgcaggagatcacgagttcgagtctcgtacggaccgtcaatagatgatgataatcaagaacgttagtcagcaatgacccgttcttttttattgagtaaaaatcaagatgactaaatagttgaccggatgggtgatcaacagtaatcgttaaggagcgcaaatgcaatttataacaacatctttcgatgagttaactgttcggcagttacaacagatttacaagttacgagtggcggtttttgtcgtcgaacaggcctgtccgtatcaagaagtcgacgatacggacttgatggcttggcatttacgagggctgaattcaacggaacagctgctagtatatgcgcgattaatgcgtgaagccaaccagcaggcccgtatcggccgggtgatcaccaatccggcggtgcgggggcacggctacggtcagcagttgctccaacaggcgattgtgcagattcaagcgttgtggccttccacgacgcaaatcaatattcaggcccagcattacttagatcgcttctaccgtggatttggttttcaaccagtctctggcgtttatttagaagatgggattccgcatcagaatatgattttaacgttgaactagtcaaaacggctgaattctgttatactaacgcatggtaaaaatatatacgtctaatgagaaagaatagtacgatgaacgtttagaccagcgagttcgggatgatgggagccgaatctaaacattattggaagcgcgcttttgaagacgacaattcgataataagtggatgtcatatcaattagagtggtaccgcgggcacgtctcgtctcttacatgtttttaaatatgtgagggactttttttgtcccgtaagacaatcaaggaggacaatatggattataaacaactcgtcgcagcggccttagcgccagcactaccagatttaacgcaggaagtgattctagataagatcgaacaaccaaagacgtctaagcagggggacttggcctttccgaccttcaccttagccaaaacgttacacaaggcacctcaaatgattgccatcgacatcgtcgaaaaagtcgatggcagtgactttgaaaaagttgttgcaatgggcccgtacgttaacttcttcttcaagaaagatgcgtttgcagccgatattttaaatcaagtgttgtcgaatggtggccattttggtgatgctaagctcggtgaagcgggtcaagttcccatcgatatgtcatcgccaaacattgccaaaccaatctcaatggggcatttgcggtcaacagtgattgggaattctttggcaaatattttaagtaagttggattaccaacccgttaagatcaaccacttaggtgactggggcacgcagttcggtaagttgatcacggcctacaaaatgtggggaagcgaagctgaggtcaaggctgatccaatcaataacttattaaaatactatgtacgtttccataaagaagacgtcgatcatcctgaaatggatgacgaggcgcgtgaatggttcaaaaaattggaaaatggtgatgaagaagccacccatctgtggtcatggttccgctcagaatcattgaaagcgttcaagaagatttaccaacgcttggatatcgactttgattccttcaagggtgaggccttctacaatgataagatgcaagaagttgtcgacatcttggaagacaagcacctcttgcaagaaagtcaaggcgccgaagtggtggacttaagcaaatatgacttgaatccggcattgattaaaaaatcagatggcgcgaccttgtacatcacgcgggacttggccgctgcgatctaccggaaacggacttatgatttcgtgcagtccctctacgtcgttgggaatgaacagaccaaccactttaagcaattaaaggctgtgttgaccgagatgggctttgactgggctgaccagatccaccacattccatttggtttgattacttctggtggtaagaagttgtcaactcggagtggccgggtcatcctgcttgataaggtcttggacgatgcggttgcgttagctcatgaacaaatcgaagccaagaatccggacttgcctaacaaggatgaagttgcgaatgcggttgggattggcgctgtggtcttccatgatttgaagaacgaacggatgaacagctttgactttaacttggaagaagttgttcgtttcgagggtgagactgggccatacgtgcagtacgcccatgcacgcgctgaaagtatcttacgtaaagctggtagcccagaaattgcggcaaccgagcaaacgttaagcgacccagccgcttgggataccttgaagttattgagtgaattcccagcgactgtagtacgtgccagcacggaatacgaaccatccgttattgctaagtatgcgatccacttagccaaggcatacaacaagtattatgctaacaccaaaatcttagttgaagatgatgaattaaacgctcgtctggctttggtcaagagtgtcagcatcgtcctgaaggaagcccttcgcttacttggcgttaaggctcccgatgaaatgtaattagaattaattaacaactgttcaaatttgaacgccacgcatactaaaccggccgttaaagccgggcgagaatgcgtggcgtttttttgttgcggccgtagaggcacggaactcgatatacaaccgatggcgaacgcaagttgtgaaccaatcgcagaaatcgcaagtaggtagcggaggcccactattgtaactggaaccagacttatcgtgtgaagtggattatcagtcgacggatcaaggctttaccgccccggccgagtaaaataagcccgattaacggccaagatagtaacaataggcacccatgaatgacaaaggaaacgctgatcgacatcatatcgtcacgatattcattctgagagagcaacatatcacggctactgacgggattgacggcgttatgataaatttgagtgattgtttgatgttgaccggtcgcatcattcaaggcacgtgaagcgactgaaatcatttgaaaagggttatgggtaagtcgtggcaataggcacattaggagtggatggccgaagaagtatgcagaagtcagatagaggttggttaacgtccaatgtaggtgaaaacggccgctgggatctgcggtgacggcataaaaagcaatcacgaaaaaaatcgcgcaacgaatatagtcggaaccgattaagctgaaagcctttttcatggttatccctccgtttgaggcttggctgtgttttcttcagataaatgctcaaactgggttgcgggcgtcatgatgcttacaaatgaccgcccatccgagttagtgaaaccaagcatgatttatgtctgattataagtcggtgtgatgatcgaaacaaacattaaaatcttaataaggcaacttccaatactaaaattttaatgacctgtttagtcgtccggggtggtattctgaaaactaattcaaaatgccatattgggggcttggtgatgagctacttagaactaacgaatatttgtaagaactatcaggttggcaaacaaacattcaacgtcttgaaggacattaacttgcagtttgaactcggtgagtttgtggcgattgtcggtgaatcaggtggtggtaagacaaccttgatgaatattattgggggactagaccatgatttcacgggaaccgtcagtatcgctggacaaccacttgattatcattatgagcgccagctggatcggtaccggcgcgaagtcattggctatatctcacagacctacaatctaatcggtcatttgaccgtgcttgagaatgtcatgctagccttagatatgactaaattaagccatggtgaccgattgcgacgggcacacgagctcctagcaaacgttggcttgacggcacaaataaaaaaatacccgcaacaattatcaggtggtcaaaaacaacgggtggcaatcgctcgagcattagccggtgatcctaaaattttgattgcggatgagccgactggtgcgctggatgcagacaataccgccgatgtcatggccatgcttcaaaaaatcgcacgggaagggcgcttggtgatttgtgtgacccattcacagcgcgtggcgggtgcggcgacccggattgccgagttggtgaatggacgaattaagtcacaaccagtgaccacccaaaatgtcggcaccacgcaaacagttgcgtcactacctgcgcggccactttcgtattgggtatcagtcatgatggccttcaagcatatgcggcatacgtggatctggaatacgctaattgtcgttggcacagcgattggattattcgccgtcatgcttttcaatggtctggggaccggcataaaagggtatattaaccacgaaatgaatgcgttggtggacccacaatcaattatggtcatgcaccaagcggataacgcgaaggatcgtgatgaacaggctgcggccgtctatgatccagctgtagccggcggtatcgcagcccggatgccggtgttcaccgactcacaactcacagcgttgcgtgaccttaagcacgtgaccaacgtggaacccgggatttcagctacaaacgcaacgattgcgattggacaacaaaagtatgccgcacctgaactgacgacctggacgagtagtgatccgacccggcagttgaaagcaggccacgtggcgggtgacaatcaaatcgtattagataagtcttcaatcgcgcagaaatggtcggcaacgcgttggcgtcagttagtgggtcgggctgtgactgtgagttatcaaaccttcaatcaaaaagggcaacccgtgaccgtggcgcgcgtgttgacggttgccggaatagtagatagtacctctgaggtcggtttgaatgcagttaactacaccacgatgcagtcgatgcgttcagcggcacgtgtctcaacacaaccaacgtttgtgagcgttagaattaagagtcgggtgcaaaatcaggtcgtggtaaatgaaattaaccacttatcaattaatggcaagcacccatttgccgcgactagtattgcggccactttggattcgttcaatacttacgttaatattgccactaaagtgttggcggcgattgcggggatttcattaatcgtttccgcattaatgattattgtaacgatgttcatgtcggtcagtgctcggatgcgagaaattggtattctgcggtcgctgggggagcgccggcgtgatattcgccggctatttactagtgaagcgctgatgttaggcattatcagtgccacgttagcgactgggctgtcctatttagctgaacgagggctcaatcatggtctggctaagctaactggcgggtatgcgctagttcagattcagctcggcaacgtaattgcaattattatcgcctggcttgcggctattttaccagcaaggcgggctgcgcgggctaatccgatcaaagccttggccgctgaataacaagtgattggataattgtcgtgatggaaaagttatgttaaccagtcaacttgtttgaaggagtggttaaaaactgtgcgagatgtcgcaaaatagtcgttttattcaggggtgggggtcattaattcattagggctggtattaacgacagcagccagttctaatattggctcgcccagggtacgcagaaacttctgattgagaaaagtaaattagctcggctaggttctgcgttactagtcgagctaattttgattaatatcttctggtcttaggtaactggggatggttatttggcagttagcgtgtacttgagacgtcgatgatggttctttacaaaccggtgctagttagttaattgacataactaaacattattagtaaaaactaatttttgagaagataagtagcaatggcaaaattcaattgtatccgtttggtagattgtaaaattannnnnnnnnnattaaatttgcaatctaccgtttaaattgattaccatacatgttggcgcttactttttatggccaaaaccgtgtcttgtcaaccctatgcagaattaatccatcgcccacttgacttattcaacgagtgaattaattcgccaacaaacttatcagtgacttctcataaaaagcccaaagtcccccctgttatacatgcaaaacactagtaattcagcgactgtccgggtatgctgttggtgtaaattaagctaaggagggttttgttttgaggaaacaaccacagacactagtcattggtggaacgcaggttgctagtggcaagagcttgttgacactggcgttagcgaacgtattgactaattggaaaatgacggtcaccatcgttagttgcaattatcaaaccgttacgtggcggaccattcaaaagcatcactgccatgagtggcagtcagatattcgaacggctaacgagctcaacaacttttggatagcgttgcagggtgtccagacggattatttattgatagatcttgattctacgggtccgaaacacgataactatacttggttactcaacgagtgctggttgccattagcgcaacaaattattttaacctattcgactgaaacggatgtcaacacgttgttgtatcaagatttaggggccttacagtttagcatggaatacacactgaccaatactaaaatctacaccgttttgaatcgttatccagcaccagtagctgttaggtcagcgatgacggccagtgacttactcccattccatcgtcaatttcaaactcggcacgcagaatttgctgcaatgaatttagagccattgggtatgttgaccgacgcccgccagcacccagaaaaagttttggcggatgccacgcaaattttaaccaaacttgtggcgtaattatggctaattattgatcaaaacgacacgcgctgtgatgagcaacgggtgcttttttgcggatgccaatcacagcgaaatatgtacaaatctggtataaatgtagtgatgcgaattttgtgggggaaatctaatggaaacgacacgagagcttatttatgatacggtacgcaaattggttttaacggatacgcggtatcacgatggtgtgacagcaatggtcattgctacacaattgaaaatgcaacgcacaaatgttagcgcggctttgaatgccttagtgcgcaaacaaaaattggtcaagactaagacgcggccagttcaatttttattagctgcgtcccacctccaagagccatttacgggactaattggtcgtttaaatagcttgcaacatgcgatcaaactagcaaaagcggctgttttgtatccgagtggtcctttgaatattcacattgtggcaaacggtggggcgggcagtaccacgtttgtacacgaaattcagaattttgttgagcaacggggtatattaacggcagctagcagccccatcattgttaagtgtcgtgattatgcagacgatattcaccaacttgatagtcaattatttggtgagcatggccagctagcgcacagtctttgggcacactccgagggcggtattgttgtgatcgaccattacgactatttagatggcccgcaacgcgcacaattgacgagtgtcatggaagccgtggcgtcccataagcaaccaccgttaatcattttagtgagcgggattgatcaggaaattcttaggacgcagcaattgataatgaaaattgaattacctgattttaagcaacgaccgtggtcagaaagatgggcgttgattcgtcgttttttgacgattgaagctcaacaatccaagcggacgattcgattggaactagccgttgcccaggcgctcatgctgtcaaattatgatcagaatttgaaaacgatgaaagcgaccatcacgatggcctgtgcgcaggcttatgtccgatttatggctgatgctgaccgtgaagttcgcgtgtaccttgcggatctatcgcccgccgttcaacaagcgttagcgcacgaacgggactatcaacaagaattggcggccgtgttggcagcagctgatttatcgtttgcggccaagtcgtcttcgggtttgagctcagattcattgcaagcgagtcggcaacaagttgagccgggaacacgtcctcgcagtgtccaagtgccaaggtcagttgaacaatcaccgtcagtgataaaaccgagtatcgtccaacagcgtgcgtccaatacgcaaaatttagcacaaatcgttgcgccactaattattaagattgtcaaagactggcaaccagattgtgaacggttattggcacggccgttgaccgagagtgtgtttaatggattatgtttacacattaatgggatgtatcgccaaatgccaacgaccaaacctgcatcagcgacaatgatcacgcaattacagtcacaacatgtggccgaatatgaggctgctgttaaattagcacaggtcttagcgacaaaactagatttgaccatttcaccggctgaagctgctttattagcaacgtttttagttgcacaatcaccagtgacgcgtcatcacccggttgtgctttacgtcatgcaaggaatggggactgcccaggccctgatgcgaacaacgaacacgctcagcgctgtcagcaatacttatgcttatgatgttgacttatcagccgatagcacgatggtgatgaaggcactgaagcataaaatcagcgagattgattgcggtgcaggtgtgctagtcatttatgatatgggggcaatcaaatggatgttgacgaccattcaaggcgaactcgcgaccaaaattcggatgattcaagtcccagtgactttagtcggagtcgatgctgctcgaaagagtgcgcgcgtaatggacgtggacgatgtttatcatctagtgcaagtcgatctaaaccaactgaacgccgaaaagacaacaaaagatgaattgattattacgctgtgtcatacgggtgaggggggtgctgcgcaattaaaagattatattgaccaatattcacggttacagatgcgcgtcaaagcgttggcaattgggcatcgtgatgagttggtggcaaccgtacttagactacaacaggtttatcagattcatgcatttgtcggcacctttgatcctcaattattcggcattccgtttatttcgatggcagcaatttttgaacattcacatcagcagttagatcaagtgatgatgtttcggccggaagctggtcgctgggatacttataatcagatctatcagtattttaagacgcagttcgaatacgcagaagttgctaagttgcagcgtgtgttaccaccactcatggatgatttgacaaccttataccaactaactgaggatcaacaaattggcctgtttgttcacttgggtagcatgattgaccgtattttggctggcaagattgtgacgacaacggcgcaaacgcggaaattagtgacccagtattcgcaagattatcagcaattacgacggtgtctacggccggtcgagcagacatttaaactgattgtgaatgatgagatgattgggacgttactggtcatcttaaagcaattacactaatcttaagtgccacggataatcgtttgagattgatatcaggaaggtgtcagctttgattttgatggggagatgatggttggttctagcattgacggagcagtttttaaatgagacttaaataagtcgcttcaagcagtggcgattgcttgaagcgactatttagatggtcagcgattcgtatgaatttaaaggcctaaccgttgacaaagtatctatggttggctcggtttgcaagttgtcgttcggtgagcaatgatttgttgttcgagttgcaataacttgtcagacatccgtccgagtagcagtgcttgactaaaatttctgagtagccaatggtgttgttgtggccgataactgtcaacatcttctagaaatgtcacggttgttttggtgccttcagcaatggtcgaataggtcacggttacggtatccagtggtgaaatagctgtcatttggtacttaatcccacgctgataatcgtcaatcgtaattttaatctgagcggccgttttggcggtcgtttttgtatatgtcagtcctttcttgattgacgttgctgtgagtatttcaccagtagcggcttgaatctctatgagtagttgtttttctaaccagtcataaaattccgtgttcgtgacggcaagtgtgcgaatgattttcatgattcgattatagcgagacattttagacagttcaaggctgaaaaaaacgtgttaaaatgagtaagctatacacccgatgaatcagctatacacaatacataaattggtcattaaacctatacactaatagtgatgaagttggatatttagtctaattcagctattatgacgccacgtgtgtgttgatactgctaattcatggaccttaaatctatacacaagcatatgtaagcgcttttgtggttaatgacaaaacttgttacgatatgtttgtcgacaaatacagaaagtaggtaaccggataatgacattagccaataatactgaaactcaagatattgcaatgacacttatcgcgtattctggtgaaggtcgtacgctggcttttaatgcgttagatgcgatgcatcgcgatgctttctccgaatctaagatgttattgaagcaatctagtgaagcactggggaaagcacatgatgttcaaacccaactactggtggctgaggcgaatggtcaacaggtttccattgatattttactaattcatgctcaagatcattttatgacgagtctgttagctaacgagttaatcgctgagatgttaaagatgtctcaaaaatttgaaaggatggtcgatttatgaaggcaatcaacgtgttattagtttgtgcgggcggtatgtcaaccagcattttaatgaaaaagttacagcaatatcgtgacgaacaaggtgttgcagggcaaatccaggcagtaggcttgtccgcgtatgaagatgtctatcaggactatgacgttattttaatggggccgcaagtggcttatcggcagggtgaagttgaggcggcaactgggttgcccgtcgctgctattccaccattggactatgcggtgggtgacagtgcccatattttcaaactggccgagaacttggtgtgatgacgagggattagtattcgggggtgaaggacgatggaacgcttttttaatagtaaactgatggtcggcttacaacgcgccggccagggacttggcaataataagtttattaccgcattacaggcagctatgatgtctttgatgggtattctaatggttggcgcgatctttcaaatcacgatgtcagtacttggaccgacgatgtttggcgtgttatcagcaaagagtattctgttagcctacttgaagattccattccaattctcaatgaattctttatcaatttgggttgttttattcttgggattccattacgccaagaatttaaaaatgacggccccaatcatgaatgcgattgacgcattatttggtttttggattgtggccggtgggttgattgtcagtaagactggaacagttagcattgatacaacctatttaggtgctcagggaatgtttattggcttcgtcgtagtttggatttccgtccgcgttgagaaattatgtacagacaagaatattcgaatcaacatgccagatgcagtcccccaatttctccaagacggttttgcatccattgtgccattattgtttaacgccgtgattttcttgggcgcatcgttattagtcacggttggaacagccggtaagtataatatttgttcgggttttatggaattactggcaattccactgagtgcactgacttcaaccataggtatttttgtcctgtgtatcttgggtgctttattatggacctttggcattcatggtacgatgattttagtcccaattgtgatgccgttagtgattcaagcggtttctgaaaatgccgcattgcaggcagctgggaagccggtggtgtttgcacctgtgatgttgttctcatttatgaccgtagcaggtggaactgggaataccctgccgttagcgctaatggcgatgcgttctaaatctaaacagctgagtgccgttggtaagctgtcaattatccccggctggttcaaaattaatgaacccatgacttttggtattccaattatgtataatccgattatgagtatcccgtttgtcctgaatattccggtagttatgttgtgtgcactcgtactatacaagattggatttttaacaccggggtggattgtaattaccgcgattttacccatgggttttggaagttatctcagtacgctcagttggcgcaacgcattgactgactatttgatgctgattccgtcagcgcttatctggtatcccttctttaaagtttatgaaaagcaactgattgccaaagaggcggcagtttcgaatcaaggtaatgcgcccatgcaacctgtgaagcctgagaaagaggtgtgaacatgcaatttccggctgatttttactggggtggggctactgccgctaatcaatgcgaaggtgcttatgatgttgatggtcggggcctgactatgaaggatattacgacaatgggaggccttaatcagcgacggcaagtcacttatttgcaagcggatggtactcctggaaaaggggattcaattcctgctggagcacacggagcggtactgccagatgactattatcctaatcagactagtattgacttctatcatcgatatcaagaagatattgcgctgtttgcagagatgggtttcaaaatgtatcgaatgtcgatttcctggtcacggattttcccacgcggagatgaaaatgaacctaatcaagcagggttggatttttatcgccgggtgttcgaaactttgaaaaaatatgaaattgaaccattgttgacgatttcacacttcgatatgccactgtatctggaggaaacgtatggtggctggaatgaccgtcgaatgattggtttttaccagcattatgcggaaacgctatttacggcgtatcgtgggctggtaaagcactggattaccttcaatgaaattaataatacaatcatgtttctggcattgcgtgccaaagccggtgatgcagattaccaacgcgcttatcaacaattacattatcaatttgttgctagtgctttagccgtacagcaagcacatgcgattgatggcgaaaataaagttggttgcatgatttgcggtatcacgtcttatccgttaacctgtgatccggcggatgtcttgcagaatcggtacgtctgggaacaaaacatctattactgtggtgatgtgcagtgccagggacagtatccaacctatgcacgacgtttatggaatgagcatcaagttgatttagacattacggacagtgatttagaagccttgaaagccggtacggttgactggtataccttctcgtattacatgtcaacggcagttacaacacatgaggtcagtgcaactgttggcggtaatttttcgatgggcgcgcgtaacccatatctacaatactctgaatgggagtgggcggatgacccggctggtctacaatattatttggagctgatgaatgatcgatatcatttaccactaatggttgttgaaaatggattgggtgccaaggattatttgacagtagatggtcaaatccatgatgtataccggattagctatctacgtaaacatattcaagcaatggcaacggcaattcaccatggcgtcaaactgattggttataccagttggggctgtattgatgtagtttctgcaggtacagggcaaatgtctaaacgatacggattgatttatgtggatcgtcaagacgatggtagtggaactctggcccgaatcccgaaggactctttctactggtatcagcgagtgattgcatccaatggtcaagatctgggcccctcggcctcaaattaaatgagtgttgctcagcagttttcgtcgatatcggatgaagactgcttttggttgttcaataagataattagccgcgtcaaacaaaacaagaggataccaccaccaagcaaggggagggtccaagaaccgagcattaagatcaaacggggtgctagcaaactaccaataacggtagtggtgtcgatgacggttaagacccccgtcattagaatattacgattgtttgtggggatttgttggatagtggtgaaaaaactaatgttggtctgtccgcgtaatgcaacaattaagaacatggtaatcataagactggcaaaggtcggccacataagtagtaagcacccaccggtgaaggccgtcaaagttagcagggattgctttgaccatcgttttagcaatagtggtgccaataagatacctgtggcgttagctgttaagaaccagctaagtggccagtgactatgcaacttgctgacgacgagccaaggaacggctactgcaatcgtcgcgtcgaccagataaccgagaacggcgtacagtaacgaccatgtcggccatgatcgatggcggtctagcttgacggtgacaaccgaatccgaggagagattggaacgtgttcggaattgccaatcgaggccggctgaaaccaagaacgctatccccattattaagattagggtagccggtgttacccatagtaatgccatcgtgacgagcattgtcgcgctaacgatggccaactggcgaatctgagtttgatagccgttgacgatttgaatatttacgggcgcaaaaaggtctggcaaaatcgttttgttactgagcttataaaagaccccaattgatttattaagaacggcgacgatgactaagcaagtgatttgccaactaaccgtatttagtgcgtaataggcaccaatgaagagtattcccgtcaaaatatccgtaatgaacatcatttgtttggctgagtagtatttaagtacccgaccagctactaggttcagaccgattgccggcagcattgtcatcgccatgacgttgccgagtaactggggatcaccggtctcttcaatcgttaaccaggtgactaggtaagtaaagccatagaagcccaaaaaggtaattaacatgctgctgagatagcagagtagattatggcggtcgttaggatgtggcctaaattcttttttcattaactgacaaccaccggtgtatgggttgaaatggtttcatagagccatttggcatcagcaatcgtcaggcgaatacaaccatgtgaattggcgactttaccaagttgctgggcttctttaacgatgtattgatcgttagcatcgactgggactgagtgaaataggtaaatcccatgatccttgaatgagacccagtaattggcgccttcacccgattgcgtgttaaaaaagtgttgtcctcgttcggcttggatttcaaagtgtcctttgggggtatcagagccatgtttgcccgtagaagcaagcatggtataaagggtctgatcgtggttttttaagtagactcgctattttttgattgaaacctgaatgttgatgtcatcgtatttagccagtttgggatacagccgtgacagggagggcttgtgccagtcaacggtctccgggactggcgtggttaccttagttgctgaatgactaactttagtgattggccgattactggcaatagcctggtggtgccgggcaaataggtgtccgaatccggtaaaaatagttaagctaattgcgccaatcgtgacccagatgagctgatgaacactgattttcaaaataccatcccttacaaaaatgattttagtgattttagtttactcagttagcgaacgtttgtttatcaaaattgtgtaaactttgcatatcattttcgtaaaattttccaaaatgagttgtgatagccattattgctggtgccacggataattcggaaatcggcaaattaaagttatttgcagtaaatcagttgttaattagacaatttttccagctaattaaaaaatcgccattaagcagcgtgcttaacggcgatttgaatttttatttattgtaaactagcgaccttagctacgattttagcaggcgtttcccattcagaacgttcaaattcggaaacgggcacttcaataccaagctgattttgaagttctagtaacagttgtacggaacccatggaatctaagataccttcatcaaataaattggcatccatattgtttgaaacatcttccccagttaaatcttgcaagatcgatagtaccgttgctttaacatcatccatgatcaaaatacgccccttatcattattgtgaattattcagtcttcattctagcatagttttatcatcgatgatggttaatcaggtgtattaacgaaatctttacttgattaaacgttaaaattggcgtgaattaaatcagttagaattttaatcccctgttcaaagcggtcgctggattcataagaaaagctcagacgaatgtactgattcggctggaaatcgtagatactaccagggttgaagagagcgttgtgcgcagtggcaaggtcgaataatttgggaatattaatgttgtcggctaagcggacccacagataaaagccacccgtgggcgtctgccaagtcgcaaaatcgtcccagtaatgatgcagaatttgttctgccgccgcggccttcttgacaagtacggaccggaaatcagcttgatacgtttcatattcaggatcagctaagatttctgccagtacaagttgtgacagtgagctagcgccgtaatcggtttgcatgcgcacgtcagtcaagcgatcgatgaccggtttggcggccaccgtccagccgatgcgtaatcccggtgcaagggactttgagatgctaccaaaataaataacgttgccagtcttatcgagtgccttcagtggctgtggcggctgctgatcgaaccagacatcttgataagcggcgttcttgtgcggtttgtaagacctgttgacgtcgctcggcactcatgacgattccagtcgggttattgaatgtcggaatcgtgtaaagaatggcatggtgtccctgaatgggggcgttcatctgccagtacgccaagccctgactgtccatcgggatgccagcgagatgggtgtgggccgattgaaagacgtgtaaagatttgacataagtaggtgcttccgtgtagatggtggcatctttgggaaatagtgacattgagaccagttggagcgcttgtaatgatccggaagtaatcagaatgttttccggatgggtatgaatcccaactttttccaagtgacgtgcaatttgttgtcgcaaagccaaaatgcccgcaggctcggtatagttcaaactcgttaactgttcgcctagatgtgcaaaggcccgttgaaaaagtggacggggaaattgttctggtgcgggttcacccgtacttaaacgaataaccgcatcggtttcaaattggttgattttttggagcgcgtgggaattgggcttgaattggcctgctttaacatattgcgaccagttgacgtgttccgccaataagctggaccaatggttacctgaaataaccatcccagagcctggattgctcgtaattaagccgactgccattagttcatcaagtgccgtaattagggtgctacgattcacgccgaattgttcggccagtttacgctgcgcaggaagcttagccccaacggcccaattgcctttcgcgatttgttcttgaaaatagttagtaatttgttggtaaattggtgtgctgacctgtttatttggttgccagttgatcgttaaaattgccatggcaaacgcctcctgagtgcccatgcgggcgaattaagctgtcattctactagccagaaatttgatgattgattcaggtggttgggtgaaaattgttaaattggttggctacaaatgaaattatctctattataatcatctctgaattaaaagctagtcggatatgaccaattgattgaacgataattggttggtaaaagaatcgaattggctggtcttaaggaggtcaaaacatgcaagtgtttttacaaggattattatttggaattgtttacattgcaccaatcgggatgcaaaacttatttgtggtttcgacagctattgaacaaccattgcaacgggcattgcgggtggctttaattgtaattgcgttcgatacgtcgctctccctagcttgcttttatggggtgggccgattgttgcagaccactccctggctcgaattaggggtgttgttgattgggagtttattggtcttttacattggctggaatctgttgcggcaaaaggccacggcaatggggaccctcgacgcggacttttcatataaagcagcgattctgaccgctttttcggtagcatggctgaatccgcaagcactgattgatggttccgtgttgttggcggcgtttcgggtgtcaatcccggcggcactgacccatttctttatgttgggggtcatcctagcatccattatttggttcatcggtctgaccagcttgatcagtaagtttaaacatctcatgcaaccacgagtcctactctggatcaatcgaatctgtggtggcatcattattctatacggcgtgaagttgctagcaaccttcatcacgaaaatatagttgcggttacctctgacaatcggtatgctagtcgtattggactttttatgagagggacgatacgcatgaagattgctggtttcggagtggaggcctggttaaacgcacatgagcgtgaagcaaccactgatattagtcaaagctcaatcgcagccttaacgatggcagaaattgcggctttagacgaccaacaagcaccacaggatttttacgaagaactaggggcggcccggatggattatggctggatcgagggctcaccacgatttaaagaactcgttagtcagttatacgagcaagtgccagcagccaatgttctccaaacaaatggggcgaccggggctaatcatttagcaatctatagtttggtggaacccggcgatcacgtgattgcactgtacccgagttatcagcagctgtatgatattcccaagtcattgggcgctacggttgattattggcatattcatgagtcagcgggctggttgccggatattatggaactgcaacgcttgatccggccggaaacaaagatgattttactcaataatgccatcaatccgactgggagtttactagatcgaacactgttagaacaggtcgtcacattagctcgctcagttggagcgtacgttttggccgatgaggtctacgagccactggatgaaaccccgttcgtctcaattgccgatttatacgagcgtggaattgcggtcaacagtttatccaagacctattcagcgcctggtatccggatcgggtggacggcgacacctagtcaagccattgctgatatttttcggaagtatcgtgattatacgatgatctgcgggggcgttttgaatgaccaactggccgttagaattttagcgcaccgccaacgcgttctggcgcgaaatcgggagctagtcagtcgcaacctcaaaattctgacagagtgggtcgcacaggaaccgcgggtcgaattgattacgccacatggcatttcagtgtcgtgtattaaactaatagtaccgatcgatgatgagacgttctgtcaacaattactgcgggataccggtgttttattagtgcctggttcacgtttcgatattccggggcacgcccgtttaggttactgtacggatacgccgacgttacaacggggtctggatttattagggcaatatttacgccgctttgattagttactagtggactggtaaccgtggttgactcattacttttaaataattatacaaatttgtttaagcacattttcctaatagtggcggaaaatgtgctttttgaagttctgtgcgtagtttgccaagtgaatatttgctataatgtattcattacaagatttggggaggtttcgcgacatgaaaaagtcagagcgccaagcagttatcgaacaattaattagtgaatatccgatcgctacccaggaagaattgatggctaagcttaaagcagagggcattgctgcgacgcaagcgacgatttcgcgcgatatccgagagatgcagatcgttaagacgccggatgagcacggtcagacgcggtacgcgatttttaaaacaactaacaaaaatgaacaggaccggctatttgaaacgctacacgatgtggtgacgagcattgaccgtgttgaattcatgaatattattcatacgttaccgagtaatgggaatctattggcggcgatcattgatgatttgaacttgccagaagtgagtgggaccttggctggtcacgacacgatctttgtcgtgagtccgaatacgacggtggcaaagcagctatacgaatcctttgctagtcacattagtaatgaagactgactgtggtgagcagtctaattggttgcactaggccgtcgttcacggtatgattattgtcattaaaagaggtgtgagatatgaaatatacgaagaaacgggcgcctcgaaagaatcaaaaacaacgcgatgcgaccttcgataaatttaaacaacaacaaaatgagctcaacgctaaccgccggggtgtccggcgcaagtaatggctgagctagctttcaagtatgtcatatggacggctcggaagctttttttgtttatggccgttttatcgtagtgacctttaatctggttacaacacgttgcctaaatcagtgatttcggcaacaactggcaaacatcgggttatctacaaaatgagttgcgtttgattgttgaagattttttcaaggttgtggtcaattactgagcatcggaaaatttatgatacaattgtaaaagctaacaagtaacgcggacgttgtgacaggtgcgtcggctgaacaaggggaagattatgcaaaaaaatggtttttgggccacgatcaaagacggcttacgagtcattggcaattggttagcaccctattggcagcgattcgctgccgtcgtcggctaccaatggcaccggcgacaaatcacacggtggctaattgtactcgtcttgaccgtcatcttaattgggagtgcctatttaacttatgaagccaagacggctaaagttggtaatttacaggcggagttagaaaagacaactgaaatctatgataaggacaataaaaaggccggttcactctattcacaaaagggaacctatgtccatttgagtagtatttcaaaaaacttacagaacgcggtaatttcgactgaagaccgtaatttctataaagaacatggtttctcagtcaaaggaatcgggcgggcatttgtcctgctcgttatcaataagatacttggccgtgactacattagtggtggtgggagtacgttgacgcaacaattggtcaaaaacgcctacctaacacaacaacagaccttctcacgtaagtttcgggaaatctttttggcgattgaaactgaaaatgtctattctaagggccaaattttagcgatgtatttgaataacgcttatttcggccacggtgtctggggagctgaggatgcgtctgaacgatattttggcgtacacgcgtcagagttgtctgttgaccaggcggcgaccttggccggaatgctgagctcgcccagtggttatgatccaatcaatcatccgaaagcgtctacggctcgtcgaaacgtcgtcttgaataacatggtcgctaataataagctttccaaaagtgagtataagctttattcgcaaaaggcgatgacgctgacgaataactaccattatgaaagtggttataattatccatattatttcgatgcggtgattgatgaagcaattaataagtacgggctaacggaatctgacattatgaatcggggctataagatttatacgtcgcttgatcaagatgatcagacacagatgcaagattcttttaaggatagtacgttgttcccggccaacgcggacgatggtacgaaggtccaaggggcctcaattgcggttgatccgtcgacgggtggtgtgttagccgtagtcggtggtcggggcaaacacgtcttccggggctttaaccgtgcgactcagattaagcggcagccgggttcgacgatcaaaccgttggcagtgtatacaccagcactacaaaatggttatacgtatgattcgaacctttctaataagaagcaaacttttggggccaataaatatgcgcccaaaaactatgataatgtttatagtaaatcggtcccaatgtataccgcgttatcgcaaagtatgaatattccggcggtttggttattgaataagattggtgtgaataaagggtatcaatcggtgaaaaagtttggcttacccgttaccaagtcggatgataacctggcacttgccttaggtggtttgacgacgggggtatcacccgctcaaatgaccagtgcctatacagcgtttgcgaatggtggtaagaaaacgacggcccactttattacgaaaattgtcgatgctagtggcaatgtcgttgtcgataatacgaagactaagacgaagaaaattatgtccgccagcgttgctaaagaaatgaccagtatgatgcttggcacgtacaatagtgggaccggggctgcggccaagccgtatggatactcggttgctggtaagactgggagtacgcaggctgattacagtacgggttcgggaacgaaggatcagtggatgattgcttataccccggacattgtggtcacgacctggatcggatttgatacgacgaacagtactcattatttgaagagtttatctgaaaatcaactttcctcgttattcaagaatgaattacaaaatattttgccgaatacgaataatactagttttggtacgaaggatgctgcgacgctggcaaccgaatctaatagtagtgattcggatagttctgatagtggatcatccgtatgggaaaacgttgagaagggcgctaatgcagttaagaacaaggctaaagactggttctccaaagccaaaagtttccttggcaactagtaaagctagcttctgaacgtactaatgctattcaagttccgttaaaaatgctaaaataatgacgacacatacttcgaggaggaactcacgatggccgtaaatatttacgatactgcgaaccaattggaacaagaattacgtcagactaaagaattcaaggaattaaaggtcgcttatgacacgatgaagaccaatgacagtgccttttcactgtttaaggactttcaagaagttcagatgcaattgtcacaaaagcagatgaatggggaagaattgacggatgacgaagttcaaaaggcccatgatttagctgataaggttggcaacgttgacgaaattaagtccttaatgggtaaagaacgtaacttgaaccaattgatgaatgatttaaatcaaattatcactaaaccagttcaagaattataccagaactaagtaaattaaggatcgaggggcaatgacggaatctgttccgtgattgccccttttttagtgggggttatcatgaaatttctacacgcggcagatttacatttagatacaccgtttcaaggactgagtggcttaacaccagctttgcaggaacggttagtgacggcaccactgagggcactcagccgactagtcgatttggcggtggctgagcaagtcgatttcgtcctgctcgttggtgacttgtttgaccaacagggccaaagtgttcaggcccaggcggcactgatgacggcgctagcgcggttgaatacggcttcgattccggtgctgctatcgttcggtaaccatgattttcaagcggatttaagtcgctggcactttccggccaatgtgcacgtgtttggcccgcaggtaacaacggctaccttaacgactgtggcacaagaacgggtcgcgattagtgggtttagctatgcgcagcggtgggtgacgacggacccagttgatgattatcctgttaaagccacgggcgttgattatcagattggtaccttgcacggtcagattggtgtggcgggtgaccactacgccccgttcaacgttaatgaattattaacgaaacattatgattattgggcacttggtcatattcatcagcggcaaacgctcaattcgcaaccaccaatcgtatatgccggcaacacgcaggggcgccatcgcggtgaaactggggcgaaggggtgcctcattgtgaatagccaggccgatcagaccttgcaaccagtatttcacgccttgactgatattgaatgggcggattggacgccaacgctcactagtccagaacccatgtcccgttcacatatcgtccatcagttagctgatcaattatcattgaagatggttaccggcttaaaattagtaacgattacgttaccagctagtcttcaactgagtgcgatggcggaattagccttaaatcagggggccattctagcccagttgcaggaacaggcaaatgaacattggtggccggttgcgattgagcaagcaacgacggatacgatgacccccttgtttggtattaacgcgacgacctggcaacaagttggtgagcaggtcgtaaccgatcaagcagtcgctgaacttgcaggcaaactcttggatgaagactttctgaacaccgcgttgctggaagatatgtcacccactgcttggcaacaacaagtggtgcgactcttaaatgatcagtaccatttaacgacgggggtgaatgatgatgcagattaagcgtcttgaaattgcgggctttggcaaatttcaacagcagcagttcgagtttggtgatgggcttcaagtgatttacggcctcaatgaaagtggtaaatcaacaatgcgggcctttattctcggcatgttatttggttttccctcccgccgtcacccacttgaacgccatgaaccacaaggtacgaatcagtacggtggttcgatagagctagtggttgacgagacgacataccggttgacccggttaggtgatcaacccgctaccttggtgaacgtgcagacgcaggccgctcaaccgctggccttacttgacaagtggttagcgccttatgatcgtgaccagtatttgcgattgtttacgtttaaccaggctgaattgacggcgctcaaaactatgcacgccagcgatttgaacgtgcaattacaacaagtcggattggtgggcagtgcaccatggcgagaaacggcgactacgttacggacagatgcggaggcgttatataagccccgcggccgcaaacccaggttgaatcaagcattgcagcactatcgcatgttgacagaacaggtcaaggcggccaagcaacggtacccagaatacgaaacattacaaaatcgattgctggatttgcaggcacaacggacaagtacccaacgtgatttaaccaagttggatcatgaacaacaacagctcgccaatttacgaaatcagtggccggtctatcaacaattgcagcaactgcaagccactaatatgacgacgacactaactacggcgactaggacacgctatcaacaattaagccaacagcgaacggaattgcaacacgccttggcgagtgcacgtcagcaattaagtcagcaaccagttgatacacaatctcaaggactagttggcttctacgtccaacatcaagaccagtttgaccaattagaagctcagttaccaaccctgcaacaaaccttaggccaataccaaacgttgacccagcagggaagtgctgccaaggctgattttcaagcgcaaagtaatgcacatcctgagctgttaggttgcctctctccgcacaaacaggccgcaatcgagaccttgaaggcgacgttggcagcgacggcgaacacgcgtcgccaacatccggccccgaatagtccatcgcttgattggcgcttgattggtggtgcaatcgggattgtcgcgggattattgctaccattaggcggctttaaatggatcttgatgttagcaggtgtggccctacttggttggtttgggatgacccgtagtcagggtaaaccggtgcaagcaaccgaccacttatcagaccaattagtggctgctggtctggcaccgaatctgactgccagtgaagccttacagcaattggaactagtcgcggcactgcaacgcgcacaagctgcggtcacgactgctgatcaagcattagcaacacaggctgccaaactctggcaattgattcagccttatcaatttgcggcaggatggattcctgttgatcaggatcatttaacgacaagtgttactcgaattgcccaattctatgatcaagtccatcaagtgatgcaacagcagaccatgtccggccccgactttgcctttgtccagcggcaggtccagcagttgacgcagcaggtccgtgatctgaccgagcagctacaggcgttagcaacgactaacggtttagcggatgtagacgcgttgacgcaagcggttagtgatgccgaaaagcaaacggccaacgccacgagtcgtcaccaattacagcaacaactcagttctgctgagctatcggcgttaaagcagtatacgtcgcttgaagcgttgcaagcggtactggctgaaagacagcaacaacgtacccaaacggcgcagcaactgacacagttagctacggacattgccacggcgcaagcacaactccaagagttgacggcagatggccagtacgctacgctacgtcagcaacaggcggatctacaaacggaaatcacagtcatggcacgtcaatggctaacgcggcagttgggtgcgaactggatcgatatggcgctacaggcattgacacaacagcaattaccaactgttttggccgcagcaaccacgattttcgcgcaattaacggcacagcggtataataagattgacttagacggtgatgaaatggttgtgaagacggcaacaacgcagttcatggtcgcggaactttcaacggcgactaaggaacagttgtacttggctttacggctagcgttgatcaatcatttgggccaagcagctcagctaccactaatgattgatgatggcttggtgaattttgatgagcaacgtaagcaagctgcttggcaagtcttagcagcagttgctcagcatcatcaagtgctctactttacgaatgagacagcggcactgacccaactgaagacagcgactgtacagcagttaacctaggggggataacatggcaaagaagttatttgattatcaattagatgaaaccgtggatggctattttttgttgaaagattcggaagttcgcatcgccaagaacggcaagaagtttttagccattaattttcaggatacttccggcgagatttccgggaagttttgggatgcaagcgatacagatgtcgaaaactttcaggcaggtcggatcgttcatctgaaaggtaaacgcgaaaactatcagggtaatccgcaaatcaaaattcaacaaatgcggctcactcatagtggcgaaccgcaagaagtgcaacaatttgtggaacacgcaccactaaagaccgacacgatggcggatgaaatcaatcagtttgtctttgaaattactgaacctaattggaatcgaattgttcgccacatgttaacgacatttcatgaccggttctttagctatcccgcggcgaagaaaaatcatcacgcgttcgccggtggcttagcctatcacacgttatcaattttgcgcttagctaaggcagttgccgatcagtatccccacgttaaccgggccttactatacgccggtgcgattttgcacgacatgggtaagacgattgaaatgtcggggccggtctcgacgacttatacgttggcagggaacttggtcggtcacattgtcctgatcgatgaacaaatcgtggagacttgtcaacagttgaaaattgacgagcagtcggaatctgttttagtcttgcggcatacgattcttgcgcaccatggtttgttagaatatgggtcacccgttcggcctcatattatggaagctgaaatcttacatgacttggacgagttggacgcgtcgattcaaatgatgcagacttcacttggacacgcagagccgggcacgtatacggagcggatctttgctatggatggtcgtaacttttaccggccaactggtgatcaaacgaagggcgaattaccagacgaacaaaactaactaaatcgatacggtgtttgaaagaactgttgaaatcaatgattttaacagtttttttgtgacctttatttttgatgacgaattccattggggtgggtgagacggtgcaccattaattagcgtgggccgtcattaaagataaaataaaaattttaattgcaattaatatcctgacatgataagttactacgagtgattagttgttatcgttgaccattgcatacgtgttgaattaggacacgttgagcagtattggcgtgcacgatgcgcgtaatctagcggccagactgattgattaaacgataatccggcaactgtggcacgtgacgggaccgtcacagagacaaatgatttaaaattgcacgcattaggggagattatcgggatgaacgaacaagaagcatatgtaacgacattttattggctcgcggattgttggttggaaactagctatctgggacttgaggatgaatttgacgacgatgaaatcgatgacgccgtcaagtcactactaaatcggatgcaagccggggcaatttatgaggtaacggcggatgatccaatgtggcaagcatggaagcgggcagttagggccgtgcttacgcccaatgatcatgctgaacatgaagttgatgagaccgacggagaggatgaattagtgctgccagctggggtacgaccagaacgtcaattagaagaagttcaagcctatgcagcgatgaacgcgtttttgcaggcacaagatcaggaatatctgcaagaaattggtaaacgggcggccactcaggtcagtggtgccgggtggcaagtgtggcgtgcacatcgccagagcatgcatccggagtttgccgccccgctgacgttgactgctgaacaattaccagccgtgatgtgggcctttttcgataagtaccaggatactgaggactcttttgagatttttgaattggttaaccagcttgaacaatggcaaaaaagtgctgatcgagatttggacgcgcaatggtcacagcttgtggcgaaaagtcagattgatccggccgcaattacgcgcatgcagggcttgtcgttagcgattgagttatttgatcagcttgagtgggacggtgatttgactgccaaggcaactttgcagaataaattgatgcaacgcacgctcgatgacacgctcaatgatgagacgacagccaactgggcggatgcctggcaacactgggatttagcagatccgttgacaactgaacagtgggcccgacggtttgatccggcggacgactatgaagacgagagtgaagaagatggcgcggctcggccagcttggcaacttggtgcgagttatagtaccgttttgattgcaatgcgcttagtcgcttacggtgtactgcggcctgagagtgtgcctggtatggcaactgtgaagatggcgaaccgtgcactggcagctaccgtcagtattggtatcgtgttagttgcttggctggtcacagctattctgattacaattgtaatttggggatggcggtggctgcgtaagctgattttttagtgcagctgaacggccaactgaatcacaatagtgccgattgactaggctgaagtttgtgaatctagtagttgaagctgaaaggacggggtgtcagtggtagtgcttcatgatggttcgtaactcggacagaaagtcggcatctaaatggggcgattgtcctaattgtaatggtgccaatggctgatataacgttggtatgtctggctttaacggctggttattgaagtattgctgaccatggattttgacggtcgctttgagcgtgccaatcgtcatgacggccacggcggtatttaaaaagacgccaccattgagactagtatatccagcggaagaacgcccaactaaagtaacgtgcgggttacgttttagcgccatgatggtcacctccgcggcactcgctgtctggttaccaataatggcataaatatgacgaaagtgggccgctgttggttgcgaaaagttaaagtcatcttgaccaagtccaccagtgatgcggccatggtacatcacacgcggccggttgcgatgatggttcgtgatgccggtgtagaggaggccgtcgggaatgatggcggccaggccagcaatcatcggtgccgaactaccaccagtattggctgcgaagtttaagattaaatcggttgtcggcttagtttgtttaatcaggtgctggagttgtgtccaatactgtttttgtaattggtgctgactgctgtaaaatgctggcacattgatgatggtgaggccggcactcattgtcttggtcggacgggtggcatgttcgacttggcggagattggcgacggcgaatgaatgtaaatttgcagcgcgcagaatttgattgagttgggtcagtgacgtgattttgcgaccatgatcagtcgcatgtagcatggcttgccattgcgtgcgatggttgataatgccatattttgacatgtaggtgatagccggcatagcgttgaaggacgcacggagccgattagaagcggaaagaccaaacgttaggactatcgaaattagacctaccagtccgtaacggcatttattcgttatcatgataagccatccttacttttcgtgactagattagcatgtattggttagctaaagtgtaggcgtggcgtcaaaatttcgcaacgaaaagcatatcttaactggtgcgtctttgaaataatggttactgttaaaatacccatctacattggccgtcttaacggctaagcagatgggtatttgttgtatcatgaaattgttgacgattgtgccagatcggcttctaactgggttaataagatcgtcaccaagtctttttccacctggttcagtgaatgctcggctggaaaggcaatgaaataattcagggacattaacgcttggggcaaaggtaagatgttatagcgttctggatcaggctgggtatgcacactgtctggtaaaaaggtaatacccagtccagcagtggctagtttggtgatggtggcggtattcgtgctctcaattacgatattcggtgtcacgttgtgcttttgtaataagtagtcaacttggcgtcgaatcgatgacccgtggggagacaagactagaggcgcttgtagcaggtcgttaaggggtagcgctcccggattaatgaaggcctgatggagttggtaccagttgacggtgttcgggataatcgcgtagtacccgtcccgaccgcggtcataactttcaagccccggcgcgatggtttccggattttgaccaattaagaagtccagctcaccgtggagcacgcgctgttcgttgcgactagcgatatcttcggttaattcgatcttagtggccgggtgggctttcaaaaaagcaggtaagaataggggcaataagtaatagccgaggctagataagacgcccagccgaattacttgctggttggcatgtgtgtattgcctaatttgcttattaaagtaatccttctcgttttcgagcgccgtcaaatattgataataagtccgcccagccgtggtcagtcgcagtggcgtgacttcacgattgatgatggtgacgcccaattctttttcaacattgcggatgctttgggtgaggtaaggttgtgaaatgtagagatctttagccgcccgggtaaaattgccgtgcttgagcaacacatctaaaaaccgtcgcatttcgctagaatctgattttggcataaagcgccttcctctcgcattgtgattaggtgagtattcgtttgattgctgatttggtcatgttgagttagttgcatcgccataaggacgttcaaaacatgttcaataagttctgtcaacatcctggcgatagtggctaaatagcattatgaccaaccattttaacatgattaattttaacgcgaatcgtcgacatagtaaatttgttatcggggtatagataaataaatatttcacaagcggagcgctttcacgtacactaatcagtattaagagtggccaatcattcaatagctactcgtcgaaaacgactgtttaaatcatcctgaaaggatctgaaattatgaaatttgttgggattgttgggacgaatgcaaccaaatcgaccaaccggcagttactgcaatatatgcaacggcattttcagcaacaagccacgattgaaatttgtgaaataaaagatttaccggcttttaatgaaccggaagaccgaacagcaccagtagcaattcaacagctcagtgataagatcaccgcagcagatggcgtgatctttgccacgccggagtatgatcattcaattccggccgtactaaaaagtgcaatcgaatggctgtcatataccacgcggccgttaattaataaaccagttatgattgttggggcctcgaacggctcactgggaacctcacgcgctcaagcgcacttacgccagattttagaggcgccggaattaaaagcactggtgatgccaaatattgaatacttactaggccgttcactacaagcttttgatgatcagggcgacctgacttatccggataaagttcaggaattagacaatgcgtttggcgaattcattgattttgtagatttaacgaataaaatcatgccgtcgagtcagtttttcgaaaagagtaagcagttctcgtggcggcaagtgactggggaggaataaacatgaaatttgttggaattgttggaacgaatgctcagcattcgtacaatcggatgttgctggaatttatgcaacgacattttgcgacacaagccgaaatcgaaattttagaattgactgatgtcccgatgtttgatgaatcgaatgatcaaactgacagtaccatcattcaaaactttgccactaaaattgcggcggctgacggggttatcattgcctcaccggaacacaatcattccgtgccttccgcgttgaaaagcattattgaatggttatcattcaaaattcacccattagatggtcaagcagtaatgattgttggggcttcatacagtgtccaaggatcgtcacgcgcgcaactacacctgcgccagattttagacgctcccggtgttaacgccagtgtcatgcccggttcagaattcttattaggtcgtgcccaaacggcttttgacgatcaaggtaatttaaaggtgcaagggacggttgattttctggacagttgttttgcaaagtttcagaagtttgcgaccatcgtcgccgagatgcgggcaccagaagcgcttagctttgccccgggtacttatcaggtgacggccactggacataatggcgaattgccaatgcgagtgaccctctccgctgaccggattgaaaatattgaaattgataccagtagtgaaacgcaggggattgccgatgtggcttttgaacgcattcccaaggagattattgcgggtcaaacgctcgctgttgatgcgatttccggggcttcaattaccagtcatggtgttatcgatggggtcgctcgtgcggtcaaagaagctggtgccaatcctgatgatttgaagaaacggcgtgcgactaagcaggtcgctcaacctgctgtcaaagaagtgacgactgatgtcgtagtggttggtgctggtggggctggtatgacggcagcggccaaagtgttacaggctggtcatcaagccgttgtcctagaaaaatacccagctgtcggtggtaataccgttcgcgctggggggcccatgaatgcggctgatccggattggcaacgacagtttgtagctttgccaggtgaaaagcaaacgttgaaggatctgagtgagcgtgatgaaagtacaattgcacctgaatatcgggctgatttccgtaaattgaaacagcagattgacgcatacctgactgccaataccaatcaaaagggcaccttatttgattcaaccttgttacatcggattcaaacttatttaggtggtcaacggactgatttgaacggtcaagagattcacggtcagtatgatttggtaaaagaattgacggataacgccctggattcagtcaagtggttacaatcgattggtgtgaaatttgatgaaagccaagtgacaatgccagttggagccatctggcggcgcgggcataagccaatgggcgatctagggtttgcttacatcaagactttacgggcctttgttgaacaacagggtggtacgattatgacggaaacgccggtaaaagaattactggtgacagatgggcaagttcgtggcgtcattgcgactaatgcggctcatgaaaaagttattgtccatgctgatgcggtgattttagcttctggtggtttcgcagcgaatactaaaatgttacaaaagtacaatacgtactggacggccatcgacgatgatgtcaagacgactaattcccccgcaatgactggtgatggaattcggctagggactagtgttggtgcagcattagttgggatgggcttctcacaaatgatgccggtatctgatccggagaccggcgaattattcagtgggctccaagtgccaccggcaaactttgtgatggtaaaccagcaaggaaaacggttcgtcaatgagtacggcagtcgtgatgagttaactcaggcggccattgataatgggagtctcttctatctaattgccgatgatgaaattaaaaagacggcttacaacacgacacaagctaaaattgaccagcaggtggcgaatgggaccttgttccgtgctgatactttgacagatttagcgcaacaaattggcatggacccggcagccctgaccaagacgattgcggattacaatcgttacgttgatgccggcgaggatcctgaatttcataagacggcctttgatttgaaagttgccgtggcaccattttacgcaacgccgcgtaaaccagcaacccaccacacgatggggggcttgaagattgatccggatgctcacgttttaaatacggacggtcagattatcgacgggctatacgcggcgggagaagtagccggtggaattcacgcgggtaaccggctaggtggtaactcgcttagtgatatctttacgttcggtcgaatcgcggcggctcatgctgttgctgagcacgttgatccggtgacggcctaaggcaattattaagtcgctacgttggttgagtcgtgttagtgtataatcgaccgtagagagaagcagatcgacaagggagattatcacatgcaaaaaccaatgccagtcgcggtgacgaacattgcggacaatattacgcaccaaccagcttatatgacgattgttttaaatgatcacaagtattcgaccgcgcgcaaaaagacgccgtttatcttgaaagcgttgaatgagggcgcggctgctcatgggcgtttgacgatcacgcctagtcggctgagtttggccgatgagcgcggcacagtctttcaaaccttggcgccaatacccacagtcatcacggacgtcgagctgggattgtatcgctcaatcgtgcggcaacttggtaatggcgtacgaatgaaggcccgttacacattggcggtgacgttgaccagcgataccgctacttatcagatgttaaataccgatttgtcagtgttgaaaccgctgttggcttggatcaccgactttcatcttcacttaaccgattcgttacaattggcaaccagtgacatagactggcccaatttgacggctgatcaatttgaagcattgacaaagggcaccccgtactttgcttggcaacagacgattggggcccactggtaagtaaaattaagaactacaaaatatgaagccagactttcgataatagtcgaaagtctggcttcgttttttattataaaatttcaccgataaagtcgcctttaggtaattgttggaagtcgtaagtttcaaaatcactcacttgtttggtataccagtgtaagctttcggtaatcatcaggttgacggcctcatctttttcctgcaaggcgatgatgggcaagtcgcgcatggtagccacacctagctcgtaggcggtaccagaatctaagtttttggcttcaaagtctaagacagtcacgatgacttgcgcggccgcaatttgggccatgtcacggtggaaaatttcggtcgcccaagttttggtgaactgttcggcttgagcgtcctggtgtagacgtggtgaataaaaatccgtgaccgttggattttttgctaaagcttcctcaagttgtgtgacccgcgtcacttgttcgggactgaaaaacggactagcaatataaatttgtgccatgaagatactccttaaagttaatttagtaaaaagactaatggcttaattttagagattttgggggtcaacgtcaatttgtttttaactactagcttgtggccacagatcaatccggtcaagtttcgaaggcagtaacgttaccacaaacgagcgagaatcaccagagcttgctcattgcaatacttggacttgccttattgttgttgatgcttgtatggttaccagctaaataagttattgtttgggtagattgtaaaattaannnnnnnnnnttaaatttgcaatctacctttgactgaaattagaatgcaatggatttagagttatacagtgggttttcagaaattatgaaggcccatttttgtgagcttaaatgaattgttgtggttaataataagtccgtcacttaatcttaaataaaccggttttgaagattcggttggaattctgaatggttcgtaacacaaggttatttccgcattttctttgtaccggttcgtaataatgggtggtactagcacgggggttaagttcggataatttgttaatggttggtaccgaaatcgttgctttgtttgaattgcgaggaagatattggtactatcaatttgaactattgagctgtgtgaccactgacagttgcctaggtcaatggttggatgattgagataaataattacagtaatagtcgtaagcttgcctttgaggattgtgggtgtcaggcattaatgattataaaattagtcgtggatagttgtgggggcagatattctgcgttattaatgataccggaatgtttttcgttaagtgtctaatttgggccacaatcgaatggcgctaatgataccgaaagttgcaattataattgttatttcgtaaaactatttgagtcatattgggggaattagcatgcaaaatccacggttaaccattattgtgccttgctacaatgaagaagcggtgttacctaagtctgcacacatcttggatggtatcttgacggatctgatccaacacaaacaggtcaatgcggcaagtaagttattatttgttgacgatggtagtcaagataagacttggaaactgattaagtcgttggaaaaacagtactcaaccgtgacgggtcttaagtttagtcgtaattttggtcatcaaaacgcgttgatggctgggatgcaggtcgccagtccgactgctgaaatagtcattacgattgatgctgatttgcaagatgacccacaggtgatcccagaaatggtggcacgctatcgtgctggtagtgatattgtattaggtgtccgcaatgatcgaagtagtgattcacttttcaaacgatggaccgcggacggcttttatcggctaatgaagcgtattggtgtgcaattagtacctaatcatgccgatttccgtttgctaagtcaacgggcagttcaggcactgttaacctatgaggaaaccaatttattcttgcgtggaatcgtaccacgactaggttttccaacaactaaactttattatcatcgccaaccacgttttgcgggtgtttcaaagtatccattacgtaagatggtggcttttgcttttgatgggatcacgtcattttcaatcgcaccgattaaagtaattttattgttcggtatggtgattagtggcggtagtttgatgatgatgctatatgcgttaatacaaggattactagggaccgcaacgagtggctggtcctcactcatgacaagtctatggtttttaggtgggatgcaattgattggtattagtattgttggcgagtatgtaggaaaaatttttgcggaagtcaagcaccggccccgctatattattgaaacggatgattatacggcaactcaacagccagctattgtgaattcgcaacgggtgcacggatgaaggccgtggttaagagcgtcaattggctggcggccgcggtattggtcgtcgcagttggcatggcgtggttgcaaccgattcacttcttcggcaacccggactgggcgtcaccggtcgtttaattagccatggttctgggattattggtcatgacgatggctggccggcaggtgctcaaacagttatcatctcgtcagtatcgttggctgttgattgggctggtcggcttaatcgccatcgtgcaaatattgattgccactagttttgttgacgtggcgcgggccgacccgtttttcgttcggcagcaggcactgttattagcgcagggcagccatcattggcaacattattttatgatttatcccaataatgtgaattttacgttattagttgcgaatctgctcaagccattattgaaactgacgcagacgccctgggtattattaaatgtcatccgatttatctggatcgataccggactaatcagtgggttatatttactaaaccgttggcgttactggcaaccgggggcggtctcatttagtttgttgtggctcgtcagtgttcccgtggccgcatttggactatttgcatatacggacgccctcgttttgccactacttccagacagcttggccttgctcacactcggactaagcttaaccggctggcgtcgttggggcgttttgattggtgatgggttattggtggccgtgggcgtggtgatgaagactaatctcattgtgctctggctcactctcgtattgatggggatcatcttgtggtggcaacgacaattcagtggtcggcaaatgttaggctggctcgttagtttagtgatgacactcggggtgatgtttgcggtgatgcgaactgcccaacagcaagcgggttatacgcgccaagctgatgccgccttaccggcaaccagctggattgcgatgagcttgaacccccaaagctcgggtgagtaccgacatggcgattttgcgcgcgttaatcagatgccaactgcggcggccaagcgccaacagacccagcaaataattcagcagcggttacatcagatgggcgttacggggaccctcgtacatttactcaaaaagatgcgggtcttctgggcgactggcgattttgatagctttaagttgaccacccagtggattcgtgcgccccgctggtatttgaatcatcaacgccagcttcaattttggctggttctaatgacgcaaacgatttacctgacgatgctggtgcaagcaatcgtgactttgatgaagcggcgcgagtgggccgtgacgttcgtcgccctggcaattctcggtttaacggcttttcatgtcggactttgggaagtagaagggcgctatgcgttgccgctattaccgggattgatgctcctcagtattgtgggtggtcgtgagttgccggtgtggcaccttaaccgagtaatgcggcgccaactgacgtggttggtcgtcgtattggcggcaatcagtgtggttagtttgtggcagacgagtcaggcgacgcggattactgatgtggtacgtggcaatcagggaaatgggcgttatgttgtgtccacggttcaaaaaattggaccgggtcacgctgttacaacgccgttagccgttagtggtaaaagtaatgttttacggttgaagccagttgcgacgcatgggcgcgtaacaattaccttgactaagggggcgcatgttgtcaaacggtggcggggctcggccaatgagctgaccactttgaattatccgttgacagcggcgggcaacctgcgattagcgattaaaaacattggtcagacgtccgtccggtatggtgtgatggcgaccaactacagcccgttaacaggccgggtgacggctaagcggcacgcgtacttacaagtcgtgataaaacagcagtttattaagccgcacgcgttaacaacgggtgccgccagtctagcagttgtcggctgtgtggcgctggcgaccattttggcgttaggtcggttacggccagaaactgaataataaaacttgaagcgaaagtcttaataactggtgttgccagtgttgggacttttatttgtggttaaacgaaatataatagccgttaatttgggtgacttatcaaggtgaggtgaattcaaatggttcaaattattgcgcatactttagtgactgccgggcacgacgttttaattttaaaacgcaatcagtttgagcgtgggcggccgaatgttgatgccagctattgggatctgcccggtgggagtgcattagctaatgaatgaccgcaagtagcggccaaacgcgagtgttgggaagagacaggcttgaaagttcaaactgagcgcgttatttgggaagatgccacctttgacaaggctaaaaatcaggtgtacacgcgtttagtgtatagcacacaggcattcgttactagaccggcaatcaacttagaacttactgaacatatggcctttctttggatgaaacctgaattaattttgactaatataagaattgtgtcctatctaaaaccgatattaacgcgactggtttagcagttacggcgaccattaaaacaacaatcggactgcctagcagaatagcttggcagtccgattgttttgattgacacgattctaatggtggcgatatcgttgacgccaaagaatgaagctaagtccacttatgattgaaatcagtagtccgcccagcaatcccgggacgtggtaagttagctgaatctgattcttaccgggctgaatcggtagggctaacatcccaccaatgaccgttttaggagtaactttgacgccgttgaccgtggcgcgccaccccttgtcggctggaatagcaacgtagagccacttttgcttggagcgattggtgacttgaccactgaccacggtatgaatgcccgagacgtggtaagtcggtgtaaagcgcgtggatagcagttgctgtttgacttggttgaaccgggcttgatccaggctggcgatgtggacatgggtgccaagcgttggttgggtacgtttgaccgttaacgtgacgacagcgcctttgtcaaaataacctagcgatcggagcactaactcaccgttggcattgaacttagtcgggactaagtgaccgttgacccgcatcgtggtgtattttgtttgacgagtcgtgtcgttataatacagcgtcccggtgcgtgtcatccttaatttaaccgtatgcaaatacggatagcgtttggcctgtgaatcttggatgacgtgatctgagagcgtcgtggcgttgccaaaataggcgcgtttcgatggccgcaaactttgtaagaggcgttcttgattgataatggcactattctgacgaagctttaactgtctaaatgctgttggcacggcaaaccctaacccgttttgactacggagccgcgttgtcgcttgacccacggcgtttaattgcacagcgtattttacatctaagagtaaatcagtgaccggatttaggccttctgaactgacacgccgggcgtttttagaaaatagcccaagtgacttcaacatgagacgtgtttggttcgcaaaagttgaactgtagtaggtaatatcgtgaaagttaaataacatcgggtcgttgtaattacgatacttgctatcataattgtaggcctgattgattagcgtattttgattttcaacgcggtataattgaccatcaggatcgttgacggcttgcatttggcggtattcggttcgataggcagttacaaatttagcctgattccctagtggtgacttcgccatcatgagggtactgttagtccctaattctaaggcgacgatacctgccaagctgagcggttgccaccgcttcgccgttgcgaataaggcaattgcggttaagatgacagcgactaagctgagcgccagcgttgaagttgttaaggggtgcttagcagttcgttgggcaaaccagcctaatatcagcgcactgaccatgagtgtcggtaacaaccattgccagcgcaaggcgatccgccgggggcctgctaaccaggcttcaaaagcgatcatgatcaagacaaagctaaagaaaaaagcattgcggtatggaaagccagcgggcgtttgaaacatgtgccaaatcgtatctaaggtacgaatgtccatactcaagaagagtgcaagtaatagtccgaagctatgccatttgtgagctttagtcaagttgggctgcacccagaaacttagggccagcaagacgaccagactactgctgaagacggttggtgcgtgtacgagccgagtcgtaaaattggcggcacctaagccaaattgactcaaaacagctaaaccgaattgtgggaccggtaagtagctcgataatttgaccgcagatttagccgtggtcagcatgcctaaaccagtggggatcaggacaaacatcgtgcttaacccactgagtagcatggtgaccacgacgtgccgaattaacgaaaattgatgacgaacagtttgccaaagactgtcctgagggcgtttgcgttcaaatagttgataaataaaatagtaaatcacaaataggcaagtcatatagcctaagtagtaattggtgacgatactgacccataaccagccgaaaaagcgcccgggatgactagttgcaattaagtggtcgagtccttgaatgaccagtggtaaccaaattaatgcatccaaccacatgatcgtaaaatagttgagggcaacgaagccagagaggctgaaagcaacaccaaaaatggcagtcgaccaccgctttgtttgaaaatgcgtttgtaaaaaagccgtcatagtgaccgcaatcaagctgatttttaacatgatgagtagactaagtccggttggcaaattggccgccggaaacaacaacatcaaaatgttaaatgggcttaatagatagtaagcaatcgtgggtagtgcgttaccgcctaatgactgtgaaaatgaatataattgaaaactatgcgttaaaatggcatgccgatacgcggtgaaaaatgataagtattggccacccatatcactaattaataagttatggttaccgaagggcgtgatcccccaaattgcgaagacaatccccatgatatcaagggacagtaatccagctgtcactgccacttgccagcgccttgtttgataattaggccacattttattcaactccgatattatgaatgatttcattgtaccgtactgaaacttgaaaactagttaagaaaagcgaacaattttctgaaaaaagttaagaattagtgttagtcattatcatttttataaagtttgctagcagtttaacacagcagttcacgaggttaaactaaaaggggtgattgacaattgattaagaaagtgtttttataaaaggtgaaaactgaatacgatttcttcggggcagggtgcaattcccgaccgacggtaacaacgtaagttgaagtccgtgacccgcgtgagcggtggacccagtgcaagtctgggaccgacagtatagtctggatgggagaagaaaattattgcttgaattttactaggcagtagtggctattggcgacctttaagtaggtttatttagctggatcctactggtgaaatctatttggcgaacacttcacacccgattatcgatgatttgataattgggtgtttttttatcttgttggaggtgaaccaatgttaactgattttatgcaaatggctatcgatcaagccaaattggcgggggtggcgacgtaccaaaatccccaggtcggtgcggtattagtcaaagacggccacgtgttagctcaaggttatcatcattattttggcggtgaccatgctgaggtggatgtgctgcggcaggtcacaccagaacaggcgcgtggggccacgttatttgtcacactggaaccttgttcacactatgggaagacgccgccgtgtagtgcgcgaatcgtcgcggctggaattcggcaagtcgtgattggtcaattagatccccatccaatcgtgggtggtaagggacgtcagtatcttttgaaccacggagttgatgtggtgacgggctgtttaacggacaaagttcgcgcgttgaacccccactacaatcatttttatgtgcagcagcgaccatggatcaccctaaaaacggcgataacgcttgatggcaaaattaatactgaaacgccgactcggacgctggtttccaatcatgctagttatatcgatagtcagtgcttacggtcacagtttcaagcaattctgattggtgaacggacgctaacgattgatgatccacaattaaccgtccgactgacggcaatggtgcagccaccggttcgattggtggtgttgaatacgagtaccgtggcgttaaaccaccggcttgttcaggacggtcaggcaccaacctggttactttgtcgtcaggctgcggctagtgacgaccaacttcgaaacagtcccaatgtacacgtcctgattggcaactggacacccgctgcaatcagtcaactatgtgtcgaacaaggctggcagtcactcttagttgaaggtggggctcatctgcaagctgaatttgttgcggctgaattgattgacgaatgggtcagctacatcgcaccaatgatgattggtgggacgggtttgccagccgttaccggggccgctgcgatgacaccgttgacatttgaacaaccaacggtaacttgtttagggacgaatatccggctacgggccgttcgaaaggaagttaagtaaatgttttctggaattattcaaaccaagggccgcgtcagccaagtgcaccaacaagggttgtaaatgacccttacgattaccgcaccgtcgctgatgacaccgagtcttaagattggtgacagtatagcggtgaacggcatttgtttaacggtaacgacccgacaagcggatgctttcagtgtagtggtgatgcctgaaacggtgcgtcgaacgaacttaaagatccttgtggtcggttcattggtgaacctagaacgtgcgttacaagtgaacgcgcacttagatgggcacattgttcaggggcacatcgattactgtggtcaagtgatgcagcgacaatctgatgcgcacgcgttgcgtctgttgatcagtttaccgtcagaatatcgcgcactagtagtcactaaaggttcggtggcagttgatggggttagtttgacggtcgtagcggtcacggagacaacgtttgaagtcgatttaattccgcattcacaagcggtgacgaccttgtctaagttacaagttggaacgctggtgaatgtagaaacggatattctgggcaagtacttggcccggcaattagcattagaggggagtcattaagatggatacaatgaaaaaggtagcagcggccttggccgcattaaaacggggcgaattgattattgttgcggatgatgagacgcgtgaagcggaaggagacatggttggcctagccgctaaagcaaccactgcgacagtgaatcggatgattacatcagcgcggggactactctgtgttccgatggcgccaagtatcgccacgcgactacatttgacaccgatgactagtgaacacgatgcgtttggaacggcatttacagtctcaacggatcaccatacgacgtccacgggaatctcggcagctgatcgggcgaccacgattcaagcgttagccaatcccaatagtcaggccgctgatttctatcatcccgggcacgtttttccattgattgcgcggactggtggattgttagcgcggcgtggtcatactgaagcggccgtcacgttagcacaattagcaggtgtgacccccgcggcctatatttgtgaagttatcaagaaaaatggcttaatggcgcggcgccgtgatctcaaagctttggcagagggcttacaattaccgctaatcaccattgaagatattaccacctacgtgattcaaacgggtgccgcccagctaacaacgaccccgagtgtcaacttaccgaccaaggatggtcagttcacgatgactggtttcgaagcccccggtcatacggcgttgccagtggcactgcaagctggtgatatcagtggcgatgaaccagtgttagtgcggttacactctgaatgctttacgggcgatgttttaggatcgcggcggtgtgactgtggtgatcaattacacgccgcactccaaaagatcagtcaagctcagcgcggtgttttcgtctatttacggcaagagggtcgcggcattggcttggctaacaaactagcagcttacgcactccaagaacacggggttgatacgtatgatgcgaacgtgcagttgggctttcaaccggatgagcgccggtatgatattgcggcattaattctacgccaaatggggattacacgggttcgtttgctgactaataatcttgacaaggttgagcagttacgtgcagcggggattgatgttgttgaacgggtccccttagaaataccagccaatcagtacgatcaagcttacttaaaaacaaaacgtgatcgatttcatcatcaactcacactaacggagggacacgaatgacaacttttaacggcaaaattaatggcaacgggcttaagattgggattgtcgtggcgcgtttcaatgcgtttgtaacgcagcagcttttaactggggcacaagaaagtttggtacagcatggggtcaatgaaaccgatattgacgtggcctgggtaccgggagcttttgagattccactgacggttcaaaaaatgattacaaccaagcgctatgatggcgtgattgcacttggggcagtcattcggggtgcaaccgcgcactttgactatgtttgtcgtggcgtgacgacggggattgcgaccgtcagtttggcaaccgatacgcccataatgttcggcgttttaaccacggataccattgaacaagctatggatcgcgctggctttaagagtggcaataagggtgctgactgtgcggtcagtttgttagaaacgttggacgtgcagcgggcaatattaaaagctgacttggcctaaatgacgtaaattaagggtatgcataatatttcaaataccatcaatttgtaacttgggccattgttgatgccactgcttctgtgccattcgctgctgatagattgccatgtgcttggcatcctggcgatagtaggggattggggaacagcgaaagtttatcaaatcgtctacaccgtatggggcgattagcttgatttgattttcgtctaaaaaggcgccaatacaagttggaacttcgacaaagtgaccaattgcatcggtaacggaagtgaattcgggatccttatcaaaattataatgtgccatatagacctcattttttatttgccattggtattgtggggctttatcagtaagttgctgatagatttttaaatcatcgctggctggtcgctcagggtcaaaaaagacgacgtcaatatcactgttgaacatcactggctgcccgctgagtacttgccaaacagtattacggatgctaccagccgccaatgcgccttgttttaaatgacagtcttgaattaattgaagaatcgtcattaaagcaggagttgttttaataatatgaataactcgttgttcgttggtcattgaaaacacctcaatttaatgttggttaaaaatagtctaacatagtaatgatatcgtgcaattcaaataaaggatttgcttttgctgatttcataaaaaattaaggccgcttaccactactaactgatagtggtaagcggtcttagtttttggttgtgagtttaagtaataattgcctagtcttccgtaacctcaatcttaccaactgcaattggtagggttacgtgagcatcatacatgcccacttcaccagcgactgatgcaggtagggctaagtcttgtgggacgccgtgaatataaatgacccgcttgtctagttctaagtcatcggtaccgaagacttctttgaacttagcctgtaggtcgcctaagggcacatcgatttcataagcgaagtggccctgcacgtcggcaactgggtaattatcatttggtacgtccatatgatggggcgcattatcaaatgggaccatcgtcgtcccagaaacaggttcagtttcaggcaagtctacaaagccgtcgtgattgacatcttgggccatagtagcaatctgtgccgctttgccatttggaaagccgtggaaatgttcccagtgttgcgtgttggccggggtatcgaacatttcaatggtgacgtgtaattggttaccagtttcagtgaaagtcgctgtgccgtgtggggcagtaccgattccttcggcgttcagcgggacgatgttagcaacgtattttttagtcatgaataattcctccagttcttcattatatggtcagtatatgctagtctaatcatataaaaattgacatagatcaagaaaaggagaaattatgcattcaaaaatggattgtgtgagtcgttcaccattattttcaccgctagcgccagcggtgaaagccaaattaatcacggtgacccatcaccggaaattttatcaaaaagggcagttgattcgtcagccactcgaccatcaggaaggcatgctcattttagatgagggaacggctaaaatttatgccttagctgctaatggtaaggagaaaattattgagttgttgcgtagtggtgatgtcgtcggacaacactggctatttgcaccgcatgagaatcagggatttattcaagccacgagtgatgcgtgggtctgttccattcaatatgatgattttcagcgattattaggtgaatcagccagtttatcattagcaatgatcaataattttgggaaccaattgattgaagctgagaagaatcaattgcgacgagatttgctggatgctaaagcgcgtttgatggcgtatttgcgcgattgtgccgttgaatccggacaaatcgaatttgaattgccgttgaagaagaaggaattggcgaatattttggggattactcccgaaaccctgagtcgtcagtttaaacaattggcggctgaagggcagattatcgtcaataagcgccagattacaatttgttagacgggtaaaggggggcgtcgcctggttttggctagttaagggtgacgctggttcaatattaaaaataaagtctgatttccaacgcagtatgggctaggaaatcagactttatttgacttgtgaggaagaggttctttaatgatgaaaatgccggttagcaacgccacttgctcgcaatgccggcaaaacgacttgatcaatgagattggtgagttgctgatcagtgttcatcggttggttgatgatgtcgcagtaccgtaattgttgaaacaatactaattgtgcggcttggttaggccaaatctgaagttcaccgtggttttgtgcattcgtcagaagtggctcgatcaaggtcaagttggcatgatcaatttgagtcactaactgcgtgagatcgcgctggttctgcgcgttcaaggctgtggcaaacaatagccgaaaatagcggaagggccccgtactagtttgttggataaagcgttgcgctaacagaatgagatcggtacgaagactgccagtatctaatggcgtggtcgtaagtgcaatgggagtcttttgtatttgatgaataatagtatgaaagatgaggtcaaaggtcgaatcccagtagcgataaagaacactgcggctggtagcggccgcagtggctactcgtgaaaaagtgacctggtcgaggccgtattgactaagcagggtataggtggtgtcataaatcgcgttttccagtcggttgccacgtcgacgttgattgagttgggtcacaaaaagatctcctaattggttttagaaacagtttactgctttttgtgccttaataatagtgatttccgtagccaaacgattgttgtagttaaagacaacgtgtatcttaaatagcgttgttaacaataatttaagtaatcagaggcggaaaatatggcaaaaattattattgtcggggctgcacatggcggccgcgaaacggtcaatggcttattagcagctaatacggataatgagattcattggtacgagcacgggcaattcgcgacggctttggattgggctccggcggatgctgaaaaagagcggttggccttgtcccagcaggtgactctattcgaccaaacgacggtcacaagaattaccccagcgacccacacgattactgctcgtaatcaacgggggcaattacagactgatcattacgatcgattggtattgagcgttggatcgttaccaatccagttaccgattcccggagccgaattatctggtgttcgatcgattcaaaaccgtgccagcatcaatgagttaaaattggccgctaagtcagcagccattaaaaacgtggtcgtgattggaggcggctatattgggatgaattttgcagccttatttaaacaaaccggcaagcaagtaactgttattgatgtgaacgctcggccattcagtcacaatcttgattcagaatttacgcaaattttagctgcagcgagtgttgagaatgggctgcaattaaagatggaagagcgggtgacggccgtattaggttcaacacacgtgacagcggtacaaacgaatcgtggtcagtatgctgccgacttagtccttgtcgcagtcggcaatcgaccgaatactgcatggctacggggaactttggcgctagattctgagggattaattgagacggatgattattttcaaacaagtgttccagatatttacgcgattggcgatgcgactaaagttcggtttacgcccacgggtactaaagagcggatcactttaggcagcgcggccagtcatgccggtcggttattagcgcataacttgttaacggatcagcgaattgtgtttcccggcgttcaggcaacgtccgcgcttaatgcggcgggatattactttgttgctacgggcctaaacacgcaactagctgtccgtatgcaacaaccggtgttagcaacttacatcgcggttccccgattggtggcatccgcaccagctcgattgaatgcgaccgttcattttaagttgttttatgataaaactcatcggatactaggtgcacaaataatgtctacagcagaattaacggcggtcatcaataccgtttcgctcgcaatccagatgggagcaacgctcgagcaattagcctatggtgactttttctttcaaccgggattaagccagccggtggatgtactcagtacggctagtttacaggcgttacaaactttagccactaactaggttgattattgccaagcccattatacggacttggcaattttaagttgatgtgttgcttaagctcagtatatgacatggaaaactagtggttactgatgattagctcattaggaactcacaggaaaaaaccgtcgcgtcatcaataatgatgggcaatccagcgacggtcaaatttaagtgatgaaatcgacaattattgtggtggtctaatggtgctttgaagtcgcgcttccaattgctagagttggggccagtacttaaggtgtacggccgaggagcctcagtttggcacatttaattgttagttcgtcacgttagccgttagcgtccaagttacggttgtgttataggtttggcccgcttgggcggtgttgccaggaacggtcaattgaacttgggtgggttgccagacgttggttgaaaggtctttccccacgttggccgttgctggggctgcaaagacgggttgttcggcggttgtgagatcgaccgcgtagcttttgagctggcccgtagcgcgttcattataggtctgcccggcaggaatgtgtaacttcgcgccggtgagttgggcgccactagtactagtaaaaggactgttctggcgggcggtgacggtccaaccgtgagttgctaaccgattatccgaaacttggagccactgtttcgcgacaccgttgattgtctgggcggcgtaagttttaggctgcatacttgttgtgacactgccaaagttaaattggctgggcgcgtagtctaaacgaagttcgcccgtattaccggtcccagtgttttcgctcccactggtattggtcgtaccagggtgctcgggctcagttggtgctgtcgggccgattgccggtgcgacggtgtattgggtagcggcggcaaacgtggcatcatgataagttgtactggtgaccggattttcgttccccgcactatctttcacaaaaatctgaatgacgtcgttagcttttaatttagtggctggcatcgcaagggaccaactcccatcactggcagcggttgctgtgatggcattgccgttgctatcagctgcggaggtcccgttaaccgtgtaacgaagtgtgttaccagccgtcgtcgtggaaccgctggcaatcgttttttggtcggcaacgatttttccatctttaacggttaccggcgtcggtggcgtcttatcttggacggttatggtgacaggatctgaagtataggtggtcgttgcttgagctgtcatagtcgtgccggccgttggaaaatgatctaaggtgaaattaacgtaaccgctgctgtcagtcgtaccactttgcgttgcgccttgatcatctgttaacttgacggttgccgtgcccgttccagcgtaaatcggcgtttgtgtgccattcgattctgtataaccggtgataacgcgaacgcggaccttcttgtcggcattggtgacgagctgggcgttcaagtcactcgtatacggtgagctgaattgcacagtcggtaatgagagggtgttcgcaattcggcgcgcagccgagaaggtgagtagtcccggtaagacgctaccgctgttggtaatcaggaccccgttctgttcgatggcggtgatcccttgataggtcacactggcgctcaacaggttcaataaggacaatgaccacatactcaggttactgttcgtgattttgaaacttttaatggtcgtctcgacgattgaccccgtttgaacgagaagcgcaaagtccgtatttttaatgtcgtaggccttaggggaatctagcaagacgctcaaaccggacatgtagccaccaaaaataggggctgagccactactagtgatatacaactcgccacccgtcacggtaaacgtactgttgttgccaagcggaatcaacggggtaacgtagtagagcgcattactactagttgtggctaagttctcaaacgtgaccttactgccagcgttggcggtaaacgtgtttgctgtttctgcccgatagacgttaccgtacatcttggcggttaggatagcgttggtacccaccgtgacggcatcatactggtcatagaaaataccccgagtcgcgtctgatgcgctacctagcaagttaacattagcagcgctaccaatagtgactttacggtctccagtcccaactgtactagttgccgtgaagttgaagaaagctttgttggcggcactgttattcgccttgcgaccgatgtaggtactgctggcggcaaaggtcattccaccagtaatcatgttttcagcgacggttgttgcggtgactgcgccactgacattgacttgattaccaggagcgttgacgaggcggtaaacgtcgctggtagtgattaaatcggtcactgtaattgtccaacgagctccaccagcattagccccaccatcggtcccactttgaatgattccggcggcgccaccactacttgttccactcgcaattgcgccacgaatactactgaagttttttactgtcattgtctgggccgtggttgtggaacccaatgtgaagttaccgatgccgagatcaaggctgtgattttgcccgtcgatggtcaggctggtggtacgagtgcctaattctgtagcacttgttgacgtgtgggtaatgttggcccccaatttaatcgtcgtgacggcggtattggtatacgctgattttaaatcatcgtaagttgagacggtcgtgctaccatctggattgaccacgattgcggcggtcgtgatatcattagcggctttggtggcagtcgctttagtcgctttcggtgtccgttctacttccgaatcagcctgcgctgtgcgactagtagcagtgtcgttgtcagcagtcgggtccgatgtcgcggtggtgctagacgactgttcggacgatttgcttgtggcattgtagtcatcacgtttcgtggtagccgcttgtgttgctgttgctgacgaatcgtcagtggtcgggtcttgactggccgaagaggtgctttcggcatcattgctgacctcacgtgctgattcagtgccggcttcttcaggaggtgagtcgactgcggagcccgcggccacggtgaaagttattggttcagcggtcatggtgtgggtcgtcggtttttcactactggcgacagctgaagcggtagtggtcgctaatgctggcccagtaatcagtgcttccgcggtcactttgtaggttttcgcttcactggcactcaataccaaatcgaacgtggtactggctgtcggatcagatggcgtcaaagttagtttccggttgtcagcatcaaaatccagctcagcgaggctcgctctgttggcttgccgggttttagtttggtcaacggtgagggcctcaggaatagcgaccatgacttggtgttcctgggaaccttgtacggccaactgaagtgtaaaaggttgcccaatcactaattccgtgggtggttcctcgaatttgattggtgtggccgtggtggtcgctgtcgcataaatggcaccgccgttgacaacgagtagactcattaagagaacgagtaacccgagccaagccgttattaatcttcgtggtcgttgcaaattgctcactcccttcggcgttgcatgagccacacgagccaaccggctaagacagctgtcaacagacctaaccagactaacagttggcgggcttcattcgtttgtggtagcactgattgatctggacgtattgccgcggatgatggtgtctgagtcgaagcctgttgattagcagtggcgatgatgttgggcaccgctagatattgatagggacgggggtgctggaagtttgtcaggtccgtcccggcttgccagtcggtcaatgtcacactagtgtcagttggggtagccgctagggcatcgggactccgacagccaccagcgagggctagtccaaggcttaatgatagtaaaactagccgcctgaatttagccataacgataacctccttgtttgagtaccaagttagaagataatctaaaattaactgcttatttaggttctgcgattgtgtcgtttcataattagataaacgattccggcggataagccagcaattacaatgacgattaggacgtaccaccagatactgatgggggcggccgggtcattcttggctttttgattattttgacgtgcttgttcagtcgtaatcttaaagtcccgggaccaatgccaagtttttttggcccatttggagtcgttagtcgttgcggtgacggataaggtataatcacccgcccgcatgacttgatcgtctaaaaaagtggggtaagtgaagttcgaattgggggccatgatcaagttgtcgctactgttctgatagagtaccttggaactgccttttctcgtgaccttagtggtcagttttaattgcgagaccactgctggttctgggttccgaatggtcgcgagcacgactttgcgatagttgcgtaatccgggagtgaccgtccccaaagtcaacttaggctgtgcaatttctttggccgtcagtttaaccgctaacgcataactatatttttggttaatattgacgctcttggatgcttttttcgcgccttgccccattttttcgaagtaccatgagcctaagattacaccggtatcgaatcctttgggaatgttgattgtggcgctgacgacccggttacttttggcggggaccgtgactttatcggaaccggctgccaaagtcgcaatttgatcaaaacgatattttaagctggcatcgtatcgtttggctgtttgggtgtaagcgatttggcctgaatcattcgtaaatgtcgtgagtagctgggtcttgaccgtaattgattggtcagtcgggttatagacccgcgcctgaattttacgagtggtgcccgccttggccttaaggtcgaaaaacggactgctagcatcgacttcttggccgggactgattttgttaacactatattgaacttcggcattggtagcggtggcctggacgcttggtgaggtccaactcatgaaaaccaagccaccaattacgccgaataagcacatcaattttttcatgattacctcctagttagtggtagcggcgactaacgtccaaactaagttgttcgtgtagttaccgacttgggctgtcagcttggggattgaaagggtcacggcacccgcgttccaagtgtttgtggaagtggctttaccaacacccgcccggttgggggcactgaaaacgacttggtcagcggtggtgacgcttacactgggggcaacaactaaattggaatcggctactgaggcgggctcgtttagcgaattacgcgcagttccttggggtaggtgaatcaccgcaccagtcagcacgtgattattactagcgttagttaacgtccggtcttgcttaacgttgacttgccagccgttggcagtggtgcgtttgtccgagacttgtagatattgattgtagttgccaattgcagtgtaagttttggctgcgttggacgtagtgacggtaccaaagtcgatagtttttggggctacatcgagggtcaatgttccggtattgttagttgccggattattcggatcggtggttgtcaacgggacgttgggactagtgggatcaactggggccgtggcactagtatcatcttgaaaagtcacggtaccattagtcgttgccccgagagccgtcaaactggttgccattaaccctaaaatcgctaaccccgtactaagacaaaagcggttaaacatggcaatccctccttatggttagctaggggtagcagcggtcaaggtccatgtcaaagtgttgctgtaggctcctggtttggccgtgtttttgggaatcgtcaaagtgacatcacttggatcccaaactttaaccgaagtgcctttaccagcgccggtagtggccgttgtattaaaaacggtcacggcaccactcgtattggtaacatcggcagctgtagtcgttaggttggtatcgaccgccgtagggtcagttgccagactattacgtgcaatcccagctggtacgtggatggtggtaccggtcaaaacatgcggtgaacttccactagtttcggttaaatcttgatcttgctcgacggttacggtccaaccctgttcatcggtcccacggttatcggtgacctgtaaatattgttgcccattagtggtcgtcgtggccttataagtgtgttcggcggcataagtttgaacggagccgaagtcgaaagttcgaggagccacgtctaatgttagagcaccagtattaccagtagctggattgtctggatcttctggaacttgtggattggccgggttagtgggatctactgggatagttggtccagtattttctgtcaattccaaattagtagttgtgttcgcagttgaatcggcggttgccatgacggcgggcattcctagtaagcttaacaacatggtcgcggtaagcactgtttttttcatgatggatcgctcctttttggttgtccgtgcctgcggtgatcaacaaatgtttggtaacgataatcaactcctggccagaagattgtcttgcgtttatcgttgctatagggctagcataatctattaggttgcggctatttttatgcatatattttgatgaatattgattagtattagcttatcaatcaggccacgatgatgtaggacagtgttgatgtgccagcactaggtgtaatggcgtataattaagtcatatgaataaataaagaatcggttaactaacgggaggagtgatgggcgtgcgccgagcggaaattatcaatggcttacgatggtcagtagtagcggacgcattagggttgcccgcggaaaatcgtcaacggggaacttatccgttaattacggaaatggtcgcaagtgacttttggaaacagccagcagggagctggtctgatgacacatcgatgagtttaggattgattgagaatttggttagcggtggtgattatgatgatctcatgtcccgatttgagaactatatgcgctttggaacgaacacgccgcgtggtgaactgtttgacattggtcggacttgtgctcatgcaattcggaattatgccatcaatcagtttccggcccgccaatgcggtgatccttcggtgcatgcgaatggcaacggcgcgctgatgtacttagcgccgttagcggtggctctgcagaatgacacaagcgtcgcacatcgactgacgataactagaaattacacgatgttgacacatggtcatgctcgttcagttgtggcgagtctaatttatttggaagtgttgcatgcgcttcatcagggacaagcgttgcctgctgcactggtatcggtgcatgaattgctaatcagtacaatcaaggatatgacacttttaggtgaactgagcacatatggcgcgttattttcaccagacttcgcccaaacaaaagccggagtcattcggactagcggttacgttgtggataccctgttggccgcatgctggttagctttaaactaccagacgccacgggaagcggtgttagcggctgttaactttggcggcgatacggatacgattgccacgattaccgcggccttaactgctgcttggcatcctgatattacagtggatacgaagtggtggcaacaaaccttaaatcataaactgctcaatgcccattttgaggtatttactgctaaatttgcgagcagctagctgacggttagtctttcggcgtgaattgtttggatgtgattaagtagcttgggaggcgttcccgggatatatttatcggtggcctggtgcaaagcgctcacgaataacgttagtcgttttcaaaaaacaagcgtttaaaatcatgattccacacaaaaagccaccctgacatgttaaacgtcagggtggcttaattaatttaattagttagagcttgatgaagatgaggttgaaaggtatgacgataagatatccttcaaatcgttatccttgattgaaacgttcccacccttaagcactttagaaacaacgttttgtaagacagtggagtcgctcatatcattgtcccaaatttgtttcttcaaatcagcggtgtgatcagacatcttacccttaccagggttcttgatcatccggatgatttcataaccgttgctggtcttaacagcggaagtcgtgtattcaccgttctttagcttgaaagcagccgttaagaatttagatgagtagctcgtgttagtgttatcaaaggctgataacttaccaccatcattcttagtcgttgtatcagttgaatacttcttggctaacttcgtaaagttggcttggctagaatccttcttcaaagcgtctaagactttgtcagcagttgctgatttggcaactaggatatgttgaaccgtgactttaggttcgtaagacttccattgcttcttcaaagctttatcagtaatcttgaccttgtctttaacggcttccttcaataataagttagaacgtaattgttccttgaaggtcttggtcgtcaaaccattttgcgataagacggttgagaaagaactaccatattgtgacttgtaagtattatattgcttcgtcacttgcttagtcgaaacttttgagccataatccttttcgagcaccttattcaggatcatttgttgcaagacttgcttacctgaagaggttcccttcatactactgtaatattggctttcggtaatcttaccaccggaagttgatgcaacggtcttgctaccacaaccagctaaggtgaaggttagtaagacaccagcaagggcaatgagccatttcttcattcctaaaacacatcctattcttgaaatcgttctgcgttagcagacttcaacgactactataccatatctattaaagcttctgcatgcatatggaaatctttacaaaattttcagagatttcacagcctcttcataaattctacctaatgcgtcagtgaatttaaacgaaatcagcttgttaagatagcaaacaaaaaaatcgtgggcctaatgcgacctcacgattacttgctcagtcggttgtcttggttaaatggtctaaggtgtcttgtaagtgatccgcacgttttttcatgatggctacgtggggttcaatcttaaattgaaatttatccaattcagtctgaatgtcatcaaaaacttccgcagcgtgggccatttgaacactgagattgctctgggcatcgctaaactcttcacgtgcgtcttgtaagttatcagcagcatctaaaacgtcttgcacgtaacttttgatgtctgtgtagagtgctttaggtgttttctgattgatcaacatgtaggtcgcagcactgagacccagaccgatcaggctgttacgaataaactttgccatgggagacctcctaattagctaattcagttttaatggcgttctgtaagcgagtgtagtcggtttcgtcatattttttggcgttgtccttaaagatcatccgaaaatcatctttatcgctgtagcgggggatgaggtgaaaatgggagtggaagacggactgataagcgaccgcaccattattgttaacgatattcatgccaatgatattctcgtcagttgctttgatagcgcgggcgatttcaggaatccgcgcaaacacgatgctggcaagatcacgatcgtaaccgaaaatatcggcaacgtgcgtcttcggtacgactaaggtgtgaccaggagtaccttgcgagatgtcaagaaaggctttgaccatgtcgtcttcataaacggtatagctcggaatatcgcccttaattattttacaaaagatacaatcgtcatcgagttttggttcaaaagctgtcatgtgataaccttctttatttattagttgggttcattatacactatcgatgttgcggcaatcaaaactaggtagcttgattgacgacaaattactgaagtttcggtaaagtcggggatcaatgagccaaccaaatagagggtgtcgtgatggctatgctataatgggagcacttataccaacacagaaagaggttaacgttatgacattagcggtacaacacttagttggtgggtattcgcaaattcccgtcttaaaagatattagttttcaagttgagcccggtgaattagtgggcttgatcggacttaacggggccggtaagtcaacgaccattaatcatattatcggtttgttgacgcccatgaaaggatcaattgcgctcaatggcgtgacattagcacaagatcctcaaagctataaaagccaaattgcgtacattccagaaacacctatcttatatgaagagttaacattaaaagaacatctagaaatgacgatgctggcgtatggtttagaccaagaacaggcttggcaacgggctcatgacttattgaaaactttccgattggctaacaagttggattggttccccgcgaacttctcaaagggaatgaaacagaaagtcatgattgtttgtgcgttcatcactaacgctaagttgttcattattgatgagcctttcttaggactggatcctttggcggtgcacgacttgttggcattgattgcgacagtcaaagcacagggagccgctgtccttatgtcgacgcacgttttggacacggctgaaaaagcttgtgataagtttgtattattgcatgctggtgaagtacagacacaggggacttttgctgaaatcaaagcgaattatccggatgcgggtgagtcgttaaacgatatttatctttcattgaccggggtgacccgtgatgaatgagttatttcaaacgcggttgcagcggcatctgcgtcggatgctgcgctacctaagattggtgttcaatgatcactttgtcattgcattgatgttttttgtcggcggactcgggctggcttattccaattggctcaagacgcttggccctcagcagacgtggatcgtctgggtgctcggtctcttattatgggcggggctaagtgtcagtcatatcgcaacgttattagaaccggccgataccgttttcctgttaccacgtgaacgggatgtgcatgcgtacttcgtgaaagcgtggcgctacagttggtggttggcgcaagcagtccaagtgatttttgttggcttgaccgtgccgttgctcatgatcgttgatcagatgacgggctggtcgttgctggcgttactcatcacccagttggcgttaaaggatgcccagttaacgctgagcgtgacgcatctctatcaagtgaagccaagcatgaagcggtggttgcgccccctgaactgggccggcgcgttcgtcacgttggcagtgggactactagtgacgccgtggttgagtgccgtaatggctatcgcgattgcggtgggacaacgttatttgcaccaacgaatttggtcgaccacggtgattgcttggcgtgacgacatcaaagccgaagccaaccgtatgttagggatttatcgattctttaatttatttacggatgtaccaatggtgcaaggcagtgtcaaacgtcgtcggtacctggattggttactacggtggttacctaaggaccagcagcatgcgtttggctacctatatacacgtggcatgttgcgcggcacggaatttagcgggttagtggttcgtttgacagttattggtgcggtgctactgtactttagtgggcacggttggttagcgatggcgttggacgccttatttatttacttgattgggtttcaattgttgccgttttacaagcaatacgataatatagtttttacgcacatttatccgctggcaactaaacagcgggtgaaaaactttcagcggttattgcgaaacgtgttaagtttgacgggattaatctttttagttgcgttctggttaagcaacgcaccgttagctcaagttgggattttgctcatcattaacgtgattgaaatctatctcttagttacttggtatttaaaattaagattagcttaaaaccttgatttatcaagggttaaaaaggacttgacggattcaactttcgtctataaaatgtgattgttaagtcaaataataatgagtcattaaataaattttgagaggagtggggctgatggatttcgaacttgatgatggctgggacgtttacccgatctatgggaatacgaataaagctttcatgggcaaaaaaaatcaccaacgattgttcttaaagcgaaacgcctcgccgttcctagcggcgctgtcgatggaagaaattaccccgcgattaatctggacgaagcgtatctcgagcggggatacgctgacagcccaagagtggttgaatggtcaaactttaacgaagcaacaaatgcggctgcctgaagtggcgcatttattggcacgtgtgcacaattccgagttgcttcaccggatgttaagaaaagtcggtggtcagagtgtccgcccacaagactttattcagcaatacttacaagatttaccagatgatttacggcaccatccgttaatggcccgggttctggatgaattaagaggaaccgcacccactttaccggccactgattatcgcgtttgtcacggtgatcttaaccacaagaactggttactatctgatcgccaacaactgtacttggttgactgggattccgcaagatttgcggatccggcgtcagatattagtatgctactatgcgaatatgtcccgttaagtgattggcaacagtggcttagtgaatacggtgagactatgacgaccgccttacggacgcgagtggtctggtatgctaagattaatttactattgaatatcaaagataattattatcggaatcagtaccatcagatgaaccatgaaattatctttttagaagaattatcgcagtacgaagtgtaacgacgagcaacaaaatcgccgcgagtcccagatggaattcgcggcgattttgttgagtaagcaaatgaagaaggagtcaatcaagatgcgtgtcagaaataaaccgtgggcgccaaagttaattgccgcccatcccgaacttattaccgaagatccaactcagttaaaaggccgctggcaaagccgttttgccaaaccccagccactccagattgaagtggggagtgggaagggccagttcatcattgaaatggctaagcgtcatcctgagataaattacgttgccattgaaattcagacctcggtgattgcgattattttgaaaaagctagtcgaggccccgctgcctaacctgcaattggcacatgcggacggtcaagcggtgactgcctttttcgaaccccatgaagttgatcgcttatatctgaacttctctgatccgtggccgaagtcgcgtcatgaaaagcggcgtttgacctacaagtcgtttttgagcagttaccgggaagtcttaaaacccaacggtcagattgaatttaagactgataaccgggggctattcgaattttcattaacgagcatgaataactttgggatgcaatttgaacaagtttggttagacttgcatgcggttgccacacctgaggataacgtcgagactgaatatgaacagaagttcagtgcggcgggcccaatttataagattattgcaactttcccagcaaaatagactgaatgagaacagcgaaacgcgtcggcgatcgctgttttttaattgagtgtaattgtcggaaacatcaaaaatgagcttccagaattttaattccagaagctcatttttgatttttgatgcggatagtcaattgtgagttattaaagccggtaaatgtctaaaatactaccagtatttgcatcggccaaaaactcgtactgtaccagctgaccatcttcatagcgggtaatgccgccatagtagacatccgtgcgcaatgcgaacttttgtaatggggattttttcatttcaatccacgagccttcaatcggtgcttccttcaaaaacgcgcgcttgacttggctaagaatttggttaggggtggggcggcgcaaccgcttgaacaggccgccaacggaaaagcccccggcgataccagccatcccaaccgctaacaagccgccatattgtaattgtttattcatgatgttgcgtctcctttcagctaacttgactaggaaatgttttatttaaatttagtataccaatgattgacgagaatacaaagaaaagtcataattaatcagtatgatttaagtaaaatacgctataataatatattgaacgctaaaatgagagtaaaggggtttcacatgttaattacaagttataatccatccgaattaggtgacacgttaatcaccattttacgaccagatgcggccacccaaacgattgaaacacatgccaatgtgacgcgtattagcgatgctgacagtggggaaaccttgggctataatttctttgacgtttccaagacgttaggcgacttagatgccaatggtcaagttcacttaacggccgaacaagttgagcaattaaataatttattaaaaaccaatgattttgaacctgaattagttttagacactgaccctaagtttgtggtcggctatgtggaatcagccgaagcacatccaaagtctgatcatttacagattaccaagacgaatgttggtttggaacaaccacttcaaatcgtgagtggttcacctaatatgcaggcgaatattttagttgttgttgccaaggtcggtgcaatgatgcccagtggcttaattatttggccgggcgaattacggggcgttgagagtgatggcatgattgtttcaggccgggaattacgattaccgaacgcgccacaacggccaggagctttgattttgcccgccgattatcagccagtgggtgcggcattcgattttaaacgcgctcagacgttatttaccgcttaatttgcagatattaaaaactaggatgattgaaaatgaaccattatgatggcccggcatttttccggaaatatcgatttaacaaaccacaagtgaataattcagcggccagtcaatcaactcctgtagcggcatcggctagtccacaatcgactgctggtgcacctagtgcgacgccaaagcgggcagccagtcaaactagcgccaagcaggtgacgagtcaggcaactacttcgagtagcagtgctgcaactagtgcgaccctctttaacggtggcacccatgggacttttcacccatcccgggtaccagcccagcttagtgcggcgctgacaaatggcggtatcattcaggatcacgataaccgtaattatttagaaattgaagcgagcttgcataagcggcccgagaccttcttattgtttgcggatgcagcagctaatgatttaccggctgttgatttgcaacaaccgctttctgatagtgggacggacacgagtcaagttgaacacccgagtgattcggcagttcttagtcaagcggaacggaagatggcttcaagtgttgacccgacaacggtaactagtcaggcagcatcgagcggggctgctcaaacggtcgtggctaacacgtcacagaccggcagtgattccacggtgtccgcagcttcggcgacggttgtgcgaccaacggaagtgtttgaacctactactcctgaattagctgtgtcggctgcggcaattaatacgcctaaaaccgatgattcagtggtagtgacggctcccacggaagtatttgagcccactgacccaagtttagcagcgtcggcagccgccataaatgcgcctagcgcggtaagttcggcagtatcggcaggccccacggaagtatttgagcccactgacccaagcttagcagcgtcggcggccgccgtaaatgcgcctagcgcggcaagttcggcagtatcggcagggccgacagaagtgtttgaaccaactgatcccgcgcttgctgaatctgctgcaactgttaatgcggctgctgatcatgataaaatagaatctgctgcgactagtgcgacacccaagtcagcacatgggctaggactatccttaggggatattatgaccgctgagcacgatgcccaggcggacttagcgttatttaaggatcagccaacaacggcggcttctgcagcaccacagtcaagtactgcgcagactcgttcacacgttaacgaagaaccttatcaaccggttggcatgcggccaactagcacaagtcctgctgtgacgtcggcaacggccacgccagtcagcgttgtggcatccacggtacctttacaggaaagtgggggagcggctagtgtgactatggcaccgtcacaggcggctacttctgcagttacaactagtcccgctttgtcagagacatctgcagtggcttcacaacctgagttagttcatagtggcggttcagcggcccccgtccttgaggataaagaattagcggcttatcatttgccaccgctgaatctgttgaaagcaccgatcgtggctaatgaatctgagatggatgattggatcgagcagaaggccagtgcgttagatgaatctctggacgcatttggtgtcaatgccaacgttgtcgattggacgattgggccaaccgtgactcagttccaagtaaaacctgctcgtggcgtcaaggtcagcaagattaccaacttaaatgatgatttgaaattggccttggctgcaaaagatattcgaattgaagcgccgatccctggccgtaatacgattgggattgaaattccaaatgcgaaatcgcggccggtgatgctgtctgaagttttagattctgacaaattccgcgacagtaagtcaccattgacggtcgcactcggtgtcgatttattcgggcaaccacaagtcactgacctgcggaagatgccgcacggtttgattgcgggggctacgggttctggaaaatcagtcttcatcaatagtatcctggtttcgattctgtacaaagcgaacccacaacaagttaaattgttgttaattgatccgaaggccgtagaactagcaccatacaacgagattccacatttattagcacccgtgatttcagaacccaaagccgcttcggcagcgctgaaatgggtcgttgatgaaatggacaaccggtatgataaacttgccgctggtggtgcccggaacattgagcaattcaacaaactggccgacgaacatgacgagccggctctaaaaatgccgtatatcgtgattgtaatcgacgaattagctgatttgatgatggttgcttctagtgaggttcaggattacattgccagaatcacccagaaagcccgtgcggcagggattcatttactagttgcgacccagcggccaagtgttgatgtggtcactggtttgatcaagaataatatcccaacgcgggtggccttcatggttgccagccagatcgattcgcggacgattctggacgcgagtggggcggaacgcctgttgggacgcggtgatatgttgtatcttggcaacggtcaacccgcaccgattcggttgcaggggacgttcgtggacagtgagattgacagtatcactcagtttgtccgtgatcaggcagcaccgcactatgaatttcagccagacagcctaatgaagcacgaggaagcagcacgcaatgaagatgacttgatgcctgaagcattggcttacattgccgatgaagataccatgtcaacatcgaagttgcaacgaaacttctcgattggctataatcgggcggccaatattattgatgatttggaaagtcgcggctacgtttcagcagctaagggttccaaaccacgagatgtttatttcacggcagcagatttaactaaattacaagccaattcataattaaaaataaagcgattcacctcatgattgatgaattgtgaatatgggagattattagcataatggataaagcaacggtttattattttgttgggatcaagggctctgggatgagctcactagccttgattttacatgacaagggttaccaagttgaaggctcagatattgaacaatatacgtttacgcaaaaaggtctagctgcagctggcattaagatgctaccgttttccgaagataacattcgcgaaggcctcacagtgattgcggggaactcatttactgatgaccatcctgaaatcaaaaaggcgcgtgaaatggggttgcccgtttatcgttatcatgaatttcttggaaaattaatggaaggcttcacgagtattggtgtggccgggactcacgggaagacgtcgacaactggtttgttgtcccacgttttgagtcatattgctcccaccagttacttgattggtgatgggaccggtaaaggcacccctgacgcgcgtttcttcgtttttgaagcggatgaatatcggcggcacttcgttgcttaccatcccgattatgccatcatgacgaacgttgactttgaccatcctgattactacaaggatttagctgacgttcaatccgctttccaacaatttggcaatcaagtgaagaagggcatctttgcttggggtgacgatgaaagtttacgacacctcgatgttgataccccaatttactattacgggacgaatgaccgtgacgactttcaagcggttaatatcaaacgaacgactaaggggtcttcatttgaagtgaagtatcacgatgaatcgttaggggaatttgaaatcccattgtttggtgaacacaatgtcttaaacagcacggctgtcattgcggtttcttactttgaaaaggtgaacttggacgaaattcggcgggaactcctcgactttagtggggttaaacgacgtttctcagaacatcaagttggcgatatggtcatgatcgacgactacgcacatcatccatcagaaattaaagcaacattggatgctgcacgccaaaagtatccggataaggaaatcttggccgtattccaaccacatacgttctcacggacgaaagcattgatggatggctttgcagccagcttaagcaaggcagatcacgtctttttgaccaatatcttcagttctgcccgtgaaaaatctggtgatgtttcctccaaagacttagctgctaagttacccaatggtggtgaaattatcacgaccgatgacatgtctgctttaacggcttaccacaatgccgtcgctgtctttatgggtgctggtgacattcaaaagtacgaaaaaatttatgaagaccaaatgaaataatttttaaaaaagcggccccagcagggccgcttttttagtctgtctttaaattgatttagcgtaaaccggcgttagcatccaagatgaaaccctatgagagatgttagattattgctagacaacagttgtgcgacctattttgaccttacaagttttaatggaacttatgcagtcgataaataaagcaccaatgaggataattcactagaatctccgtcattggtgttttattagtgtgtatgatttctaaggattaaccacgtggttagtgaggcaggtgcagtagtcttagttttgttgcttctgggctttgtttaacattttcttagcttcacaatcatagtcgcaggccgcacatttgccctttttagcacgtttgaccacgcgataaatctgatagccagcagccccaataattagtgcgataattaagaaattaacgaataatgccatgtgaatcaaactcctttcagataaataattgaccaacttggtaaatgacgaaggccaaggtgtaagcaatgaccaaactcgagcagacggcgtaaacagctcacttggtcgatccagtctcggacttgatggtcccaatcgtggcgaagcacgggacatatagcaagatgaagacgagcatcgcgtatgcggataacggtgtgaaaaagcgccccatcatggcaatcaagccggcctgatttgcgctgtggaacattaccatcatactagagctgatgacttctttggctagaatcccagtaaagagggctgagataacttgccaagcagtcacaccgagtggcgcgaacagcggtaatagtgttttgccaagtgtcgcggcaaagctgttgtcgatgtcgctgactaagccgctagtaccgaatgaggaaagtaaccaaatcaagaccgtaccggcaaaaatgatagtacctgcctttttgatgaaccctttacccttatcccaggtgccacgccaaataatgtcagcccggggaatatgatactgtggtaactcaacgatgaagacggaactatcatcgacgttgaaaatcagttgataaaatttagccataccgagggcgaccgcaatgccaagaaagtaaatcgacaagacaattagggcctgatttttcgggaaaaaagcggccacaaataggctgtagattggcagacgggcggagcaactcataaatggggaaatcagcgttgtaattaagcgttctttaggttgttcaattgtccgggcggccataataccagtgacgttgcatccaaatccaataattagggggataaatgccttcccgttgagtccaatcatctgcatcaagcggtccgtaactagtgctgctcgtgccatgtaacctgaatcttccaagattgaaatacaggcaaacaagacaaaaatttggggaataaagacgagcacgccaccgacccctgcaattaggccgttaacaatcagtgagcgcaagaccgggatggctccagccatggtcaaccagtgactcacggtggtggatagtggtccggagacgaagctatctaacaaatctgacaggggcgtgccgacccaatcaaaggataatttgaacatcaagtagaagattcccacgaagacgggtagccctaagaacggattggtgacccacttgtcgattttagcagtcatctcgacgtggctggtgcttgccaagttttgactagcgctggctaaggtttgctcaataaagtctagtcgggtttggaagatctgctcgtcgaatttttgagcgtcgtaataagcggcttgactagtgagtggtgtcaatcccatgtgtttcgcgtaggctcgaattggcttattttgattaataaattgaatcgtcagccaccgtgcgaagtctgctgtcaaatcaaattttttgatgagctgttggctagcctgacgaatggcttgctcaatcatgaaaggatagttgagtttgagcggtgtcgcggccggatggggacctgccaataagtcttcgcgtagctgatgcagcccttctttattgcgggcgttagtcgctttgatctgacagccaagttgttcagctagcgtgtcaaaatcataataatggcccgtccgtttgaggtcatcaatcatgttgagtgcgataatcaccggtgcgccaaattccaacacttcgatcgacagtagtaagttacgcttgagctgactcgcgttggtcacgttcagaattagatcagggtggttatgtagcagatagttggtgacgactgcttcatctttggtgattggattaagtgaatagactccgggtaaatcgaccatttcaacttcagagtgccgaatccggcccatcttcttctcaacggtcacgccggtccagttaccgacgtacgcgtatttatccgtcagttcattgaatagcgtggtcttaccagtattgggatttccgagcaatgcaaccgtcgtcatcttaatggcctccaatcaacgtttgaaatacggtgtaccgaatcccaatccgttgttgatcaatctgaacaattactggtccgtgaaacggatagtagcggacaacggccagcggactgccgacatgtagccctaagctgtgcaatcgttgaacggtctgattatccaaacctgtgaattgttgaatatgtagttgtgatgtattagtaacggattgacttagcataaggctcagtcctttctgaatattccaatagtgaataattcatcaaaaatattatacctacatcatagcatgaaagggcttttattaatatggggaaaagccttattttcttttgaaatgaaaacggttatactctaagtatagaatacaaaaaggccgatgttacgctatttttgttgaagccgttgactaatcattatatacggaaggaataacggcttgggtaataaattcaattgttggaggatgatttaaatggcaaccttggaagttaaagatttacacgttgaagtgacggatgatgagcaaaaaaagtctcgtgagattttaaaaggcgtcaatttatctatgaaaactggtgaaattcatgccattatgggaccaaatgggactggtaagtccactttatcacaaactattatgggccaaccggcttatcacgttactcagggtgatatcttgttgaacggcgaaagtatcgtaaacatgccagttgatgaacgtgcacgtaagggactcttcctcggcatgcagtatccagctgaaattcaaggggtcaccaacgctgaatttttacgggcagcaatgaacgcacgtcgaccagctgatgatcaaatctcagtgatggcctttcttaaagaactcgacaagaacttggcactacttaatatgagcgaatccatgacggaacgttacctaaacgaaggtttctccggtggtgaaaagaagcgtaacgaaattttgcaattattgatgatcaagccatcattcgccttattggacgaaattgattccgggcttgatatcgatgcgttacaagtggtttctaagggtgttaattcgatgcggggcgataatttcggctcattgattatcacgcattatcaacggctgttaaactacattgtgcccgatgtcgttcacgtgatgatgggtggtcgaatcgtgaagactggtaacgccgacttagcaaagacccttgaaaaagaaggttatgctggtttacgtgacgatttgaacattgatgtcaaacttgttgacgacgaagattagggggtggcagtaatggaagcaactgctgattatgaaactatcaaaacaacgctagctgcggctgctaacgaacatggtgaaccgcactggctcgttgaacgccgtttagcggctttagatgcgatgcaaggcctagcggttcccaaagctgatcgctttagtattcgcgactggccactgacgcccaccgaccaaccactaaagttcagtcgttcggatcgaactttagcaactgatgtaacggctgaagctggtcatatccaaatcgtacaagttgggcagacaacggtgaccgtcaatttgcctgatgaactagatgatcagggtgtcattttgaccgatatgttcacggcttttcgcgaacatccacagctaactgaaaaacattttatgggcaaagtcgtcaaaactgacgaggaccggttgaccagctaccataccgcgtttttgaacgccggggtcttcctatatgttcctaaaggggttactgtcaaagaaccaattgagatcaccacgattcaggatagtacccgagtgcaaccgttaattagtcacgtcttgattgtggctgaacaagacagtcatttcgcagtaactcagcacctgacaacgaagggtgacgtcgataatatcgccaactgtgttgtagaaattttggcacgggctgacagtgaagtgcatttttcagcgttcgatgaactcggggccaacacgactgcttatttgaatcggcgggccgcgatcagtcggggagccaaagtcgattgggctatcgggatgatgaataacggtaacactttcggggactttgactcggaactgatcggtgagggcgccaaatccgatgccaaggtcatcacagtgacgaccaaggcccaggatgtctgtgttaatacgcgggtcactaaccgtggtaagaagactgacggcaatatcgtacaacgtggggtcattatggaaaagtctaacctgatttttaacggaatcggtcacattattcacggggcctccggtgcacatgctgaacaggaaaatcgggttttgatgatgtctgatgatgcccatggtgacgcgaacccgattctattgatcgatgaaaatgacgtgttagctggacatgcagcaagtgttggtcaaattgatcaaaatcaaatgtactatttgatgagtcgcgggattgataaaccacaggcccaacggttggttattcggggcttcttaagtaccgtgattggtgcgatcccatcgaagactgtccggactcgcttaacgaacacgattgaaaggaagcttgaagatggcatccaattttgagacgttacggtcagattttcccattctaaaccaacaagtgaatgatgaacgacttgtctacctggataatgcggcgactgcgcagcgccccaaccaagtcgtggatgcgctcgttcacttttatcaacacgataatgccaatgttcatcgcggtgtgcacaccttagcagagcgggccactagtcaatacgaagctgcgcgcgccaaggtgcaacggttcatcaatgctgcaaaaacggatgaaatcgtcttcaccaaagggacgacggatagtctcaatctgattgccagtacttatggcgaagccaatattcaagcgggtgatgagatcgtcatttccattatggagcatcatagtaatttaattccgtggcaacagttagcattgcgtaagcacgccaccttgaaatatattgagttaacggcgactggtgaattggacatggccgatgctgccaacaagattacggatcgaacaaaaattgtttcagtgacccatgctagtaatgtattgggaacggtcaatccaatcaaggcgttagcacgattggcgcatcaacacggtgccgtgatgattgcggatggggcgcaagcagcccctcatatgccggtcgatgtccaggcactcgatgttgatttttacgcattttcagggcataaaatgctaggaccaaccggtattggcgttctatatggtcgtgagaatttattagctacgatgccaccgtatcaatttggtggtgagatgattggctttgttcaccgtgatgacagtacctgggcggaactaccgtggaagtttgaagcgggcactcagaacattgccggtgcgatcggcttgggcgcggcggttgattatttgacgcaactcggtatggatcaagttcagcaacacgaacagcaattagtcaattacttattgcctaagttgattgcaatgcctggtgtcacggtctacggtccccaagatccccaacatcatacgggcgtcatcgcctttaatatcgacggtttgcacccgcacgacgcggctaccgcgttggatatggaaggtgtcgccgttcgcgcgggtcatcactgtgcacaacccctgatggcagcgctcggcttagtagtaactgcacgggctagtttttacatttacaatacacaagcggacgctgatcaattattaacgtcactccaagcaacaaaggagtttttcgaacatgggactgtctaaattaagtggcttatatcgcgaagtgattttagatcatggtgatcatccgcatcataaaaatgcgttgccaaacgcaacacatgccattacgttgaaaaatccaacttgtggcgacgtcatcaatttggctattcaattggatgcgcatgatcaaatcgaagatattggatttacgggtgagggctgtaccatcagtcaagcatcggccagtatgatgacggatgcggtgatgggtaagtcgaaagaacaggcattggcaatggctaagacattttcggatatggcgattggcaagcaacacccgcaggccgatatggatgccttagaagacgccgcaattttatcgaatattatgcaatttccggcacgaatcaaatgtgccacgctagcttggtgggctttgcaacgggcattgcttgctgaaaatggcaatgaggaggaatcagaagtatgagtgaagtacctgacgtggtcaaaaatgaccgtgattatgaatatggatttcatgacgatgtcaaaccagcatattcaactgggcgaggattaacggaagccacggtgcgcgaaatttccgcggcaaaacatgagccacaatggatgttggattatcggttaaatgcctatcatgagtatttaaagatgccgatgcctaagtttggcccggatctcacgaaactcgacttgaaggacatgctgtattatcagaagatgaccgataaaaagttccgtgactggaaagaagtcccagctgacttgaagcggacgttcgaccggttaggtgtgcctgaagctgaacggaaatacttagccggttcatcggcgcagtatgaatctgaagtcgtttatcacaatatgcgtaaagattttgaaaagttaggtattatttttaccgataccgatacggcgcttcacgattatccagaactgttcaagaagtggtttgggaaactcgtcaaaccaaccgataacaagtttgcggctttaaacgcggcggtctggtcaggtgggtccttcatttacgtgcctaagggtgtccagacgaagacgccaattcagtcatatttccggttaaatgctgaaaactcgggtcagtttgagcggactttgattatcgtggaagatggtgccagtgtcgactatgtcgaagggtgtacggcccctaattattcttcagatagtttgcacgcggccgttgttgaagtcaatgttgagcccaacgcttactgccgttatacaacgattcaaaactggtctgacaatgtttatagcctggaaactaagcgagctgcagcggccgaaaatgccacgatggaatgggtcgatgggaatttaggttcgaaggttacgatgaagtacccaagcgtttatttgaatggggaaggtgcccgcgggaccatgttatcgatcgcggttgccagcaatggcatccaccaagattctggtgctcggatgattcataatgctaagaatacctccagttcgattgtttcgaagtccatcgctaagactggtggtgcgactgattaccgtggaaccgtgcgttttgccaagcattcagacggttccaaagcgcatgttgagtgtgatacgattatcatggatgaccagtcgtcttccaacacgattccgtataatgaaatcgacagtgctaacgtcgcgatggaacacgaagctaaggtgtccaaaatctcagaagaacagctctactacttgatgagccgaggaatttcagaagctaaggcaaccgaaatgattatcatgggattcgtagaaccatttacgaagcaattaccgatggaatatgctgttgaattaaaccggttaatcagctttgagatggaaggttcaatcgggtagtaagggggattggttaagctgatgttaaaataaaacttgagtggcatgcgagattgcgattcgagttttttggttaaatgattgttgatgaatgttagccattataatcgtgccagctaggatggttgataattgtagtaatttaaaattgtatctcggttagtgtttttatcatgctgattcgccttttcgttaatattggcgacgtactttattataaattaggattattaacgtatattctaacaatggtataattaaaaacagttttaaacagacaggagtgtggcagaatggcagacgaacttggcgaggataaggccctctcacccgttgaagacgcggtcatgaagtcgttagagcaggtgattgatccagaactgggcgttgacatggttaaccttggtttgatctatggtgttgacgtagacgataatggtagctgcacggtaacgatgacgctgacgacgatggggtgcccattaggaaatttattggcaagtcaaattaatcaagcaattatgagtgtggatggtgttaagaattgtgaacttgacttggtctgggaacctgcttggggaattgataaaatgagtcgttttgctaaggttgcccttggcattcatggctaacgggtgagacaaggtggtgtgcgatggatattgaaaagtttattgcccggcgaaaagctttaaaaatttcacaagtcaaattatcaaacggaatttgtacgcaggcgactttaagtaagtttgaacggcgtgggcgagtaccagcattagcaattttaaatcagctctgcgctcgtctgggattgacagttgatgatctaagtgaaaaccaggctaattcagtgacccaaattcgacagcaacttgatgagattgagcgacgactgatgatggaagattatcaatcagtcctgcaatcattggtagacctgaaagttgagcaaattgatgcggtaccttcacggatgcaatattactatttatgtggcatgctaagttcgttgattaatggaacagccagtgatatttgtttttccttctcgcaaatcgttgatgatttggatagggctcaccaaacaattttcacaccgctagcttatgtcggtctgggtgtcatgtatggccggttagctgagcctgagaaagctcaattttatttcaggagagtacgatactatgtcgagcacgctggctcatcaggatatgcaaatgattacttacggctgttaaccctaatcttttatacggcagagtattacgcaattagtggtgatttcgtcacaagtaatcgtctaatagatgatggggtagcgctttgctcagatgaacatgtcacgtattacttaccaagattgaaatacttagcgaccgagaatgctgttaagcaacaactttcggataaattgattaagcggttaatgagtgaaacagaagcttttgcacggattaatcataatcaagttgttgaggttaaggtagctgcattgcgacaacgatatttgcagggtattgctgcttcagaaaacaattaacaagacaatggctagatttagtgttttattgtagtttccaacatgctaaaactaatcaatgctttgtacattaaataataagaagtcccacactagcaagtcaatactagtgtgggacttcttatttagaaagttatgtatgacgccgcccgcccctaaaaaatcttccccggatgtcccgcaaaaagtcctaccgattgaagttctattataaacgcttatggtgtcccattccggaaaatcctaatgtagcggtaatccattaaagacaatgattgaatggaattcacttagacataagaaattcttattaaattcacaggcacaaactattttaccttctttgactaatttgatagacttaagttaagaaagttgaggtgactgattgagatggctagtcataggcaaatgattgacaaactagtgtggtgttgttactagcgcagtctgcgttagtaacgatgcacaaactcaatttttaatcttaactcggaaaaagtaacgagtagtcaatttttaggtgaaagagggattttatgaacaattttcaaaatgacccacaaccacggaccatcaacacacaagttggcctccgtagtttcctaactaaaatgtatgggtttatgacaatcgccgtgttagtttcggcctttaccgtttacttagcgatgaccacgttccaagcacaaattaatgccgccttttcacaacacccattcatcttcttgatgatcttcattgtcagcatgtttgtgatgattggtgggattcaagtcaacgcgacacgcaatccagcgatgagcttcaccttactgatgctctttgccatcatctttggggttgaaatgtcagtgaccttgtccttatacacgggtgccgttatcaccggtgcgttcgttgcagctggagctgtatttgcgaccatggcggtgattgggacgacgactaagcgtgatatttcacgtattgggacgcacttgattgcagctttaatcgggttgtttgtcgcttcactggtcaatatgttcttacaaagtgccatgattagttacatcttttcatacattggtgtattgatcttcgccggcttatccatgtgggacgctaaccggatgcgcaacatgtatttacaatatggtgaccaggtttcatcgactggtttggccgttactggggccttacaattatacttggacttcgttaacttgttcctctacttcgtccaaatcttcggtggctcaagccgcgactaatcattaagataattattaaggattatgaccaagatgtcataatccttttaatttaccgaaaatgagttatttcacgggttttcggtggaccgaactcccgttttacttaattgtttggtacaattataagggtaaataattagtcgttcagcctgtactgacaggcgctgcgaatcagaccgccaatcgagtggtattaatggtctgagtgacggattttcataaaaatgatgatttaaattaagagatggggagcaaactaatggcaaaaaaattattactgattgatggtaacagtgtggcatttcgggcgttctttgcgttgcatagtcaactggaacggttcgtaaatccagacggcctgcataccaacgccatttatggcttcaatacaatgcttgaccacatgatcaaggcagtcgaacccacggatatgttagtggcttttgatgcgggtaagaccacgtttcgaacagccatgtacgataattacaagggtggccgggctaagacgcctagtgagttttctgaacaaatgccgtatatcaaacagctattagacgcgtatggtatcaaacattatgaattaaaagactacgaagccgatgacattattggcacactggccggtcaagcggatcaaaccggctacaccacgacggtcgtcactggtgaccgtgatttgacgcagttgacgaccgagcataccacggtggccgtgaccgttaaaggtgtttctgaagtggaacactatacgccggcgcacgttgaagaaaagctgggcatcacaccggcacaaattattgacatgaaggggttgacaggtgatacctcggataactatccgggtgtcaccaaggttggtgagaagaccgcccttaaattactcaaacagtatggtacgatggaaggcatttatgaaaacatcgatgccatgaagcagagcaagatgaaggaacatctgattgaggatcgcgaacaagcggcgcaggctaaggtgctagcaacaatcaagcgggatgcgccgattgatgttcaattggctgatttatcctatgatggcccggatcttgaccagctggccgcgttttatcagaagatggactttcaatcatttttgaagaaattacacctacagtcggacgaaccagcaacgcccattgattataccgtcttgacgaaagctaacctgacggaattgcaacaatttaccgatcacgtggacttttatttggagatgccaacgccgaactaccacacgtcggcctttgctggctttgccatcggagcggatgatcactggtacatcagtcgggatgtggaattattaatgcaaccgactgtggctgatctcttgagtagcacaacgattaccaaggacgtttttgatatgaaacgcacgacggtcgggcttaatcgtttgggtattcagctaggtaaagtcgattttgatctcttactcgtttcatacttattagatacaaatgataacagtaacgacttgggaagtttagctgagcaacacgggtacactgacttgccgagtgacgagaccgtttatggtaagggcgttaagcgtgccattcctgaagatgatgatgtctactttagtcatctcgcccggaaattggccgcgatcgctagtttgaagccacagttattaaaggaattggcagccaatgagcaggatcaactttacgatgatattgaaaaaccgatggccaatgtcttagctcagatggaaatcgccggcattacggtcgacagcagtcgacttaaagccatgggcagtcagtttacagaacggttgagtgaaattgaacagacgatttatcaagaagccggtgaagagttcaatattaattcacctaagcaactaggtcacatcttgtttgaagaaatgaaattacccgtaatcaagaagaccaagacagggtattctaccgccgtagacgttctagaaaagttagcaccggaagcaccaatcgtcgctaatattttacaatatcgtcagatttcgaagattcaatcgacctacgttgtcggtttgttagatgccattcattctgctgatcaaaaagtgcatacgcgctacttgcaaacgttgacccaaaccggccggttgtcgtccgttgatccaaacttacaaaacattccggtgcgcttggaagaaggacgtaagattcgacaagcctttgttcctagtcatgaaggttggcagattttctcgtctgattattcgcaaatcgaattacgggttctcgcgcatattactgatgatgaaaatatgcaggccgcttttaaagcgggtgatgatattcatgccgcaacggccatgcgaatctttcatttgaactcagctgaagaggtgacgccaaatattcgacggcaagccaaggcggttaactttggaatcgtctatggaattagtgattacggcttgtcacaaaatatcggcattacgcgtaaacaggctcgcagctttattgacgcttacttcaaagaatatccgggtgtcaaaaagtatatggatgaaattgtccaaacggcgaaaaaacaaggttatgtggaaaccatttcacatcgacgccggtacttgccagatattaattccaagagcttcaaccaacgctcattcgctgaacggacagccatgaatacccccatccaagggagtgcggctgatattatcaagattgcgatgattaagatgcaagataagttacaggctgcgggtttgaaagcaaccatgctgttacaagttcatgatgaattgatttttgaagcgccaaaagaagaaattccagttttagaaaaattagtgccaagcgtgatggattccgccgtacagttagccgtaccgttaaaggttgagagccactacggtgatacttggtacgatgcaaaatagggggaaccaccatgcctgaattacctgaagttgaaactgttcgtcgcggcttaaatcgtctggttagcggggcaacgattgctagtatcgaggttttttggccgaaaattattaataatgatgtcgatagtttcaaacagcgtttagccaaccaaacgatccagaccattgatcggcgggggaagtatttattgtttcgctttagcaatggtctgacgatggtgtcgcatttgcggatggaaggcaagtataatgttgtaccgcgtggtgaagatcaaggtaaacacacgcacgtgatcttccatctgaccgatgatcgtgatttgttgtacaacgatacgcgtaagttcgggcgaatgacgctcgtgccgaccggtgaagaaaacacggtggcgggattgcggacaattggcccggaacccgttgctgaacagttaacactggcttatatgacggccacttttggcaagtcgaaaaagatgatcaaaccactattgttggatcaaagtaagattgcgggcattgggaacatttatgcggacgaaacgctatggatgagtaagattcatccaatgcggcctgctaattcactaactactgatgagattgcaacattgcgccaaaacattattgatgaaatggcgatggcaattaaaggtcacggcaccactgttcattcattttcaacggcatttggtgaggccggtcagtttcaaaatcacttacacgtctatggtcgtgaaggggaaccttgcgaacggtgtggcacgattattgagaaaatcaaagtggcacagcgagggacccatttttgtccgttagaacaacggttgtaggtgatcaagatgacaaagctgattggattgactggtggcattgccactggtaagtcgactgtttctaagctgctggcaactaagttaccaatcgttgatgcggataaaatcgcgtggcaggttgaagggccaggccaaccgacgacccaaaagattgtggcgcactttggtcagcaagcagtgctggcagacgggcggctgaatcggccatggcttggccagttggtttttaacgatgctcaagctttacaagccttaaccgcaattacacggttaccgattcagtacgcgatgttcgaagcgattgtcgcggcaaaccagcaacagcccgacgcaattattttagatgtgccgttgttatttgaaagtggctggcaacatgtttgtgatcaagtgttggttgtgacggcaccaccagccgtagtattgcagcggttaatggcacgtaaccacttatcgcaacaggcggctcaggcacgaattgacagccaaatgccacttgcacagaaggtcgcaagggctgacgttgtcattgataacggggccaacattgataaaactaaagcagccgtgttaaaatggctgaaaactattactaaataaagaaaaactgattgttagttgttacaaggggtgagaagtctatgcaatgtccacattgtcatcataatggctcccgcgtggttgacagtcgaccaactgatgatggtcgcgtgattcgacggcgccgggaatgcgaaaactgtgggttccggttcacaacatttgaacgggtcgaagccacgccattattagtcattaagaaaaatggtgcccgcgaagaattcaatcgtgaaaaagtcttgcgcggaattattcgctcggccgagaaacgacccgttagcatggaaaccatgacgggcgtcgttgatgatgttgaaaataaggtccggtcactgggcgaaaatgaaatttcaagccaagttatcggcgagtatgtcatggagcaattggcagatattgacgaaatttcgtacattcgttttgccagtgtttaccggcaattcaaggatatgcacgtcttcttgaatgaactccaagatatgatggagcgtgataaggtcaaactggcaaaaccgtcagcgaagacgacccacgcacctaaacgaaaaaaagattagtgaaaaagaatggtgaacaacatgccaaatgatgaacccttaacacccaaaactgggttagtggtcccgcaagcaccagcgctcagtgcggcgcaacaagctgtattggcggaattatacttgccactgatggggccattggcatatagcttgtacgcggcgttacgtagcttacagagtagcgagaatgagctgagcaatcgacgcagtcacgcggaactgcttggcatcctaaatgtggacttgccgacggtgttagcggctcggcgtaaacttgaagcaactggcttgttgcgcagctattatcaacaagatgaattgggtgccatgtacatttatcaattacaagcaccattactggcgttacaattctttgcggatgatctattgagtgtcctattgttagatacggtcggtgagttacgttatcaacaacttgctggcgattttgcagcacagccgattgacttgacggctgccaaagacgtgacggcaaatatcttagatgtgtttcacgttgatagtcaaaaagttacgacgccacctctttcagtgcaaaaggtgcgcgcccaattggcggccaatgaaccggccgaggatcactcgcccgtgctcagtgacgatgactttgactggcaactgttggggcaaattttgaagcagaactatgttgatctcaaacaggttgcgagttcacggcaactgatcattacggaaagtcgggtctacggcatcagtgagattgagatggctaagttaatcagtgaagtggctagtttaacaacgggtcagtttgatgaaaatcaattgaaattattgattgcgcggcgctatgaacggcccgcagtttcgagtcagcaggtcgctacggaagcaacggttgcaacgacgaccactaaggataacaaggcttcagcacagctctcaacggctgagcagcaactcgtgacgtatgctaagcagacagcgccgtatgactttttatcagctttgaagcaggagaaacatggttttgtgacgagcggtgagaaccggctagttcatgatttaattggtcggggggtattacccaatgccgtcatcaacatggtgatctactacttattgcaaaatcgggagttagctgcccttaatcgtaatttgctagaaacagtcgccaatgattggcaacaacacggcattacgacgccggaagcggctttgatgtatttgaagcaacgtaaacagccgaaatcaacaccaacacggcgcaagaacaatcgaccgacgcgtaaggagattatgccaaagtgggcccaacaacagcaacagactgagagtggtaagcaaccagctcagaccggtaaacaaattactgctgcccaacgcaaacagcttgctgatcgactagcaaagcttgagacaaattcggaaaaggaggactaaaacatggagaatatctcagaaacactccggacgttaatgaatcggaaaaacttgaatcatcggtatgaggcgttaatgacaactgtgtaccaagatccagatgttcgccagtttttagctgctcatcaaaacgaattatcttcggatgcgctagaacgttcagcggctaaattatatgaattttgtgaagagaaacgtaaaattgcgcggcacgagccaactcaagcacctgggtatcagccgacattagtgatgagtaatcacttgattgacattgcttatcagccaacaccacaaatgcaagaacagcaagctgctcacgcattgcaacagcgggttcgatcaatcagcatgccgaaaaatattcagacggcggacttaaagacgtatgatcaagatggtgaccgggcgacagcattaatggcagcacttgattttattgatgcctatacacaagcgcccaagcgttttcaccggggcttatatctctacggctcatttggtgtcggtaaaacttatttactcggtgggatggcgaacgcgttggctgctaagggtttcaatacgaccttgattcattttccgagttttgcggtcgagatgaagcgctcaattagtaacaatacgtcggcggataaggtcgatgcgattaaacgggcaccgattctcatgattgatgatatcggtgcggatgcttcgtcgacttggattcgggacgatgtgctcggggttattctggagtatcgaatgcaggaggaactgccaacttgtttttcgtctaatttttcgatgcaagaattgcaagatggttatttgacgctctcacaaaagggtgatgaagaaccagtcaaagcgcagcgaatcatgcaacgggtacgttaccttgcgagtgagattgagatggtcggtcgtaatcgacgactcaatcccgatgcttaaaatcaagagttgacttttagtttaaaagtggtttaatgaaaacagatgcaaaagacacgctttgtttaccatggattgcagagaccaagaccttgttctggaagtcttggaccgggtttacgaagataccacttttgtgaacatgctcaattgagccggaacgcttccgttattagcgctaatgagtcagtgtctttgatgacactgaaaaatcgggtggaaccacgtcaatgacgtccctaatgctagttcagtctggcattagggacttttttgtcgtcccggcgcggtgttttggtgagtgggtaaattttaaggagagtgtcaagtatatggcaagtattaatgttaagttcccagatggtgctgaaaagcaatttgatgccggcgtaacgacggaagcaattgcaaagtcaattagtccttcattggctaaacggtcggttgctggtaagttcaacgatcagatcgtagactatcgccaaccactgacaaccgatggtagtatcgaaattatcgctgctgatagtgaagacggcctcaatgttttacggcaaacggctgcccaagtattagctaacgcggttaaacaattattccctaacattcattttgggagtggtgaagggaatgccaacggtttcttctttgataccgacaatcctgacgaagacggtaaacaagtcagtgaagatgatttggaagccatcagtgataagatggctgcaattatcaaacaagatttaccaatcgaacgcgaagtcttatcaaaggctgacgctttagctttagttggtgacaacccttaccaacaagacttagttaacgaacgtgccgctgccaacaatgatcaagtcgttgtttacaagcaaggggacttcgttgatttatctgacggtgcccaattagcttcaacggggaaagtcaaggtcttcaagttattatccgttgccggtgcatactggcaaggtaagtccagcaatccaatgttacaacgaatctacgggacggccttcttaaagcaaaaagacttagatgctgacctcaagcggcgtcaagaagcccgcgaacgtgatcaccgggtcattggtaacgaattagacttattcttcgttgatcctaaggtcgggaatggcttgccttactggatgccaaatggtgcaacgattcgtcgccaaatcgaacgttacattatcgacaaggaagttgcaaatggctaccaacatgtatacacgccagttttagctaacttggacgtttacaagcaatctggtcactgggaccactaccgtgaggacatgttcccaccaatggacatgggtgacggcgaacaattggaattacggccgatgaactgcccatcacatatccagatttacaaccatcacattcgctcataccgtgaattaccattgcggatcgctgaactcggcatgatgcaccgttacgaaaagtctggcgccttaactggattatcacgggttcgtgaaatgactttgaacgatggtcataccttcgttgcgttggatcaaattgaagaagaattcaaaaaaatcttgagtttgatggttgaagtatacgaagactttgacatttctgattaccggttccgtttgagctaccgtgatcctgaaaacaaggaaaagtacttcgatgatgacgctatgtgggaacgcagtcaaaagatgttgaagtccgctatggatgatatgggcttggattacttcgaagctgaaggtgaagctgctttctatggtcctaagttggatgttcaaactaagacggcccttggtggtgaagaaaccttatcaactatccaattggacttcttgttaccagaacgctttgacttgaagtacgttggtactgatggtgaagaacatcgtccagttatgattcaccgtggtcttgtttcaacgatggaacggttcgtcgcttacttaactgaaatttacaagggtgctttcccaacctggttagcacctaagcaagtaacaatcatcccagttaacaatggtgcgcacggtgcctacgctgaaaccgttcgtcgtcgtttggcagctgaaggtgttcgggtaagtatcgatgaccgtaacgaaaagatgggttacaagattcgcgaatcacaaacgaagaaggttccatacttgttagttgtcggtgaccaagaagttgctaacgggagtgtttcagttcggaagtacggtgaagaacggactgaatccgaagccgttgacatgttcattggtgccatcacgcaagaaatcaagcattacagtcgtggtgcaagcaaataattaacagccaatggcatcaatattgattgatgggttgacaagggccgtggttcttgttaatatattggagttgagaaaaaaagcagaagcacccgcttctcgccttggtgaccagagtcatcgggcagatgaacgatgaattgattcccattaacggggttgagcgggcgtactatgcgcccgctctttttgtgaatttctctaaaatatttcggaggtgaattaccatagctaaagattcaatggttaatgacggcatccgtgctcgcgaagtacgtttgatcgccagcgatggtgaacaattaggtgtcaagtcacgacaagaagcaatgcagattgctgaagacgctagtttagatctagtattggttgcgccgaaagcgaaaccacccgtggccagaattatggattatgggaagtaccgtttcgagcaacaaaagaaggatcgggaagcccgtaagaagcaaaaagtggtcagcatcaaagaggtccgcttgagcccagctatcgacaccaatgactttaacacgaagctgaaacatgctgaaaagttcttgtcaaaaggtgacaaggttcgcgtctccatccggtttaagggccgcgctattacccataaggatattggtcgccaagtcttaaatcgaatgattgaagctactaaggaattttctacggtcgaagcctatcctaagatggatggtcggagtatgttcctagtactagcaccaaaaacagataagtaatttctaggaggattattgattatgccaaaacaaaagacaaaccgcgctgctgcaaagcgtttcaaggtaactgctaagggtaagattaagagcgccaacgcttttactagtcatcgtttccatggtaagactaagaaacaacgtcgccaattacgtggtacggctattatcgaaaagccaatggtcaagacataccacaagttattacaaaaataattcacaacgttttagttaaatctaggaggaaataacatggctcgagtaaaaggtggaactgtaacacgtaaacgtcgcaaacggattttaaaattagctaaaggttaccgtggtgctaagcacatccaatttaaggttgctaaggaccaagtaatgaagtcatacctatacgccttccgcgatcgtcgccggcgtaagagtgacttccgtcgtctttggattgcccggatcaacgcggcagcccggatcaacgacatcagctacagtcaattaatgcacggtttaaagttagctaacgttgacgttaaccgtaagatgttagctgatttagctgttaacgatgctgatgctttcaaggcattggttgacactgctaaaaaggcacttgcttaatttaaaacttaattagggcttgctctaatgtttgaacgaccgtcatcctgtatgggtggcggtcgttttgttttgacgcttgattaaggggcacgattcctggacaagatggttcggtgtgttgacgtccttactgaatcttgagattgatttgacacattattgtgatatagtaatgatgtaagcgcttacttatgtgttgattaattatttagctgggagctttggagaaggggtgtcaccatggcaacagttttacctaaagcagttaaggtctggatgggcgccaacatcttgcagattgagtttgataatggggagtttcgatacatgcgtacacatttcattgatgactatgtttctgcgtggtcacccaaaaagggtaagggaaagcggcgcaatttgtggttaatgccatcttgggaatggttgggtgccaatgctcggattgaatcggatggcactgtcgtgttgttcgaaaaggatgtttatacggcccaagaactttggcataatagtgtgacgcgaattgacttggtctctggcgtgcactgattcataaaagatgatgccaaataaaaatggacttggtcatttgactgagtccattttttgatgccgcttggagtatacgtggataacggcctaagtgagccatttagtgcgcgactctgatttatgaaaatcgagtgtgatttctgattggttaagccagtctgccattgtctattcgtgataatcttcgttataaataaagcgatgcagttttaggtattgtgcaccgagtttgcgttcattttcattatctttagggtaataataacgacgaccagccaatcctttaggcatgtagttttgttgggcaatctgatgtggcatttggaatggattatcgatcagaccaccacctgtaatttcctcggagtgtttgtagtgcatatcgcgcaatccacggggcatggggtgctgacttggattttgtgtgtcctggtctagtttttcccaagattggtcaaacgaaccagacttgggtgaaatgcacatcagcatggtggcaaacattagtggatattttgctttgggcatgccaatcttttcggcttgattggcagcgaccacaatttgtgtgacctgttccgggttagctaagccgatataagtgtatggaatttcacgtagccggcggaccactgagggtaagtcatcattttttaacaaaatggttaagtagtagagcgccgcgtcagtatctgagccagccatcgaatccgaataagccgacagatagtcataatgcttagttgccttccggtcgtagctaaaatgctgttgctgggcaaagtgttgtaccgcagcaacagtgatttgcttctggtcaatagcgtggagcgtttccaagatatttaacgcaattcgcagatccccttcggccgaaatagcgatcaggttgagggctttagcatctacctgatcgtcggttaggttgtaaatgtcggttaccgcacggcgtaaagcaatctcgatatctgtatcgctcagtggttgaaactcaaaaatttgacagcgcgaacgaatggccggaacgattgacataatcggattttcggtcgttgagccaattagcatcacgtgcccattctctaagtagggcaacaaaaaatcctgcaatgttttagtcattcggtgaatttcgtcaattaatagaacaaacgattgctctgggtattgtgcgatggctttcgtcagctgtgccttattttcggtcgaagcattaaaagccacgaatggataatcgtcttgactcgcaataatctgcgccaaactagttttgccagttcccggcggcccccacagaatgaggggaatattaacatgttgatcaataatctggcgtaatggctggcctgccttcaacagatcctgttgcccgaccatctgttccagtgattgcgggcgcatttgatcagccagtggtgttttaaatgccaatttcaaagtcctttctgattaagtgttttagtcaaattgatgctatcatcatagcactaatattttggaaactgaaaaagaaagtttggcaggttagcggggaacgatgctgaaatgagtgagtctgataccataggtttgacgttggctcgagtgatgggttgaaggtgtattgatttaagttttcatgcttgttgatgaatgagaaaggcgatattgtttcgtagatggtattgagtcagcttggggagattaatagcttggaattaccccccgtgtatacggaaaacagattaaacgaatcccggggagtgcaacatcagttgtaagcactaaaagacagaaaaggacagcgtatttggcgagttaaagttgatcattatcgcgcgagccgtaatacccgtcaactcatttccatccttcaataactaccttgccaatcatatgatgttgctcgataagttgatgggcctgccgcaagttaagcgcgttgattggccgtagtgtctgcgatagcgtgctttgaagcaagccacggtcaagtaaatccgcaatggtttctaagatatcgtgctgactaatcatgtcggccgtgtggtagtaggattttgagtacatccattcccaagcaaatgtcccgcgtttcttggttagttttttaaggtcgattggacgccgattttcggtaattgatgcgatgtggccaccgggtttaatgagcgtacatatctcattccagtgactgtcaagatcgcttaatccgaggatgtaatcgacatctttaatacctaaagcatgtacttcactaaccaaatcatgatgatgatcgacgactaaatcggcgccgtgttgctgcgtccaagcgatactttcaggtcgtgaagcactactaataactgtgagccccgctaattttgctaactgagtagcaattgaaccgacaccaccagcgccattgatgagaatggtttgattgcatttttcggaattaggtttagctgggtcaaaaggaatgtgaagttgttcaaataatgcctcgtatgcggtcagcgaagtaagtggcatggccgcacgggcagcggttgttaatgtcgcgggggcgtgaccgacaaggcgttcatcaaccaggtgataagcactgtcgcagccgggacgtctaaatgagccagcataaaagacgtagtcgccgggttgaaacagggtgacagcttctccaacagcggtcacaataccagtggcgtcccaaccgaggatcttgggtcgcatgaggtgctcatgccccgttttacgaacgctaacgtcaacaggattgacagcgacggcttgaacttgaacaagtaagtcatgaccttgagcgctaggttttgcaatcgtcacgtctcgtagactagcaggatcttcaataggtaagtggtcggtaaaaccaattgcatgcattattaatcaaacccctttcatgacattactataggttaccagtgaggaataaacaagacgtgaattatttgccacatagggacatatttgtcacgcctattagttgtgctacaatcaagacacttaattaaggtaggggaagttagatgcagcgacaagtatacgattgtacgccgggttgtccggttgaaagtaccttgcaagttattgccggcaagtggaagagcgtgattttgtatcatttatttacggcaggaacatgccggttcagcattttgcaaaaacgactgccgggttgttcgcggcggatgctagctcgccagttacaagaattggttcaagacggggtgattgcaaaacgagtttatccggtcgtgccaccgaaaacggaatattggatcacgccatttggtcagaccttgaaaccggtgattatggctatggagacgtggggccgacagtataattcagtgaatggaaaacctcgtcaataggaatgtgagaacgggcatagtgtgagtttcaaggaattgttgtcggttttgttaggggcgattgtgcttggtgccttgctcgcattaatagtgactgtttaactaggctagtaaagaattgatgtgattctttactagcctagttgttttctaatctaataaaacgggagtctgacgtaaaaagtacaccgatagatcactgtttggcagcatttcttgaataatcatgggtttgcagtaagcaatgataccgtattaagtctgagataggttgtggattagttgcttgttaggaggtgcatgttagataattattaacaacttaatgaagtgcagcatggccgtgaatctcgttcgctaaatgggggtgccattatgaaaaattgctttggaatcattggtgggatgggaacaatggcgacggaggactttgtgcataccgtgaaccggctgaccgttacccatcgtgaccaggattatttaaactacgtcattttaaatgatgctgagataccagatcgcaccgcatatattttggatcataactgtgccaacccgttaccatcattggaagcggatgtgcagctacttaatcaattaggggtcatgtttattgtgatgacgtgtaacacagcacattacttcattcccgcattgacggcgctttctaacgtgccaattttgaatatgccggccttagcggtaacagcagcctgtcgatcacagcaaccgcgaccgttacgaatcggtattttagcgacaacggggacactagagtcgcaactttatcaacaacttattcggtctaatggacatattcctgtgatacccaataagcagcagcaagcttaagtgatgaccttaatttatgacgacatcaagcaacgtgattttgtagatcgggtcaaatttcatggcttaattgatcaattattgaatgctgctgattgtgacgccgtcattctcggctgcaccgaattgtcggtggctcaggatgctgcgccatatgattctgaacgaattattgacgcacagtatgaactagctcgagcaaccgtccaacgcgcacaggcaactaagccagcgttgatacttcgtcggcggccatcgattaggcggtaggaggggtgcaggtaactggataaaaatgatttttgatctatttagtacgtgtgattgtagctgttataacaccactttcgtatacatgaagaatagtaaaattgtaagcgctcaaatcgttgctaactagcctattctcgcacatgcaaggttgggtccgtctccacacagtcccgcacaacaaaaaagcgagccttcaattgaaggctcgctttgtgttctcgattattcagtgtggtgcttccgaactgggctgacccaggtgccgctgccgtaacccaggatggttttaacggctggaatcagcgtagtgaccagagcgagggcgttaacctgccagtaaatcagcatgtagagtggcatgaaaatcagatatttaaacttgcggccacggtcgtcaacgatcaatgcggacaatagctgcaagacgccggcgaacatttcgaaggtcacgaagatgaaggccatgcagaacatatgatagacgcgctcgtaattgccagtaaagaagaaggtgacgagcgagatcaggaagatcagtgttgagacaaagaagaatagggaccagatgatgctcagcgtttgatcagtaataaaagcccattgcttcaaatacttaccgggatgactgacaacccgtttaaagttggtcaacagcacttcggtaccacctttggcccaacgtttgcgttgatgataaagggcgtctagattctcggggacgttcatatagaatagaatgtctggcgagaaaacggtcgtccaaccattcaactggtgatcccaagcaatactgatatcttcggtcgcgcgatcttgccggaataagccgacgtcaatcagagcgtcacgacggtacattgtattggcaccactataggcatacatgttacctaaagcactgacttggctccgcttgataacaccaacgatacttgaaaattctacggtttgcgacttagcgatgatcgtgcttcggttctgaacgtccatgttggccgtgaccgctgccgtattggcgtgttcttcgcccatgaagtaactcatatatttccacagtgcatcgggttctggaatggaatcagcgtcattacttaaaatgaattcaccacgggcaaagccgacaccgacgttgaacgcgtgggccttaccctgatttttcttgattgttaccacgcgtaggttgtcgtacacgctctggagacgttctaaaatagctggggtctcatcagtcgaaccatcgtctgtgaccagcacttcatatttttcataatttaaattgttcattaaatagttgattgtgtgttcaatcatgacttcttcgttatgcgctggaatcatgatcgtgataaagggttgttcttcaggcgttagcggttgaaattcaatatcgtctttgtggcgatggcggtaaatcagctggtagcagagtacaccgataaaccaggcaaatgcaccgagaattgggtaggagactaatagtaatagaacaaagttccagatactttcaaagggcttaagtgtttgcattatttccattggctagtcctcatacaatctgtggatttcgttaacatcgagattttgttcggggtcaaccgtgtagtgcttgacgtgttgccggaaagtggcctgcccgaatcgttgggtataaaagttatttagttgccgcttccgaatatctaactggtcttcgttgtattgccgttctttactgatatgctgcttgacccggtgattattgtgaatcgtggagacaatgaccacaatggcgattaagataaacgcaataataaagaaccggtcaaaaaagtagaacagcgtcttaccttcttcgtatttccaggcgtgaatgaactggggattattcgcaagtaacgttgacgagatagtccagtagacaggtacggcaacgcagatccaagtaataattgcgactagggtttgccaaagtttcgtccaccagtgccccttggaaaaatatttatcggtaacgtattgtttcataacatcttttttctccataaacgaacctccgagatgacatattgtttagtgatcgtgcggatcatatagtttatatcattactgatattgtcagtttatcgacatagaacaacaccagggcgcctaacattaactgcgatgaacagttttagaacaatctgaacatttaaccatgtcaataagcttacatgaggattgcattgatgtgcaatcaatatacatatcagtatcatgatataagtaaaagccacgtatctttaattaatatacacttaatgggatactttgttaatctaatttgacaaaacggtcagtgcgacaattgaatgtcaacttgtggtttagccattgcaaataaactggcgagaaaagggcaaccggcaaaacatcgctgaatttactggcgacttttagtgctattttcaatgtcttactcgggccccaacctatcaaataaatgcggatgcgatcaacttagtcaaatttgatccaggtggtgtcatcaagttacgacaacttggaaggattttcgttgcttattttcaaaaaacaaattattatataatgatgactaaaatttagcacaattgcctagtgaaatccggctccagacctgatttagtccggtatttcaccaatagtatgataaaatgggctagtggggttatgccaataaccaaaaaatccagcgagaagcgaaggggataacgatgattaagcaatttaaaccaacttggatgataccagcaatctacaatgtgacaccggcgcagttacgagcgcagggcattaaggcggtatttaccgaccttgataacacgttgatcgcatgggacaatccggatggcaccccggaactgaaaaagtggctgcacgcgttacaagacgcgggcattccgttagtggtggtgtcgaacaattccgaagcgcgaattgctaaggcgctgcaaagcctggaactgccatttgtttcgcggtcactgaaaccactaccgctggggatcagtaaggcgcgtcatgacctgggcttacacaaaaatgaagtggtcatggttggcgatcagtatatcaccgacatgtgggcggcccatcttgcgggcgtgcccagtatcttagtccagccaatcgtgaagacggacgcgtggaatacccggataaaccgtttctttgaacgatttatcaaattacgattagcacatgtttatccagaaatgcattttcaggaggaccttaataagtgagtgaaacatcagaagaaactttatactgtattgggtgtggtgcggcgattcaaacgaccgatcctaaggcggccggctacacaccgaacagtgcgttacaaaaatcattagctagtgacgcacaggatttatactgtcaacgttgttttcggcttcggcactataacgaaatcgtgccggttggcttaacggatgatgattttcgtcatttgttagccacgattcgagatgcgaacgcactggttgtgtacgttgtcgacatttttgatttgaatggaagcatcattcctggtctccagcgctttgttggggataatcccgttttgttagtcggtaataaggaagacgtgttgccacgtcagttacgccggacgaaattgcgggaatggatgaatcaacaagttcgtgcacagggaatcaaaccggtcgacgttgcgttaacgagtgccaagaaggggcattccattgatgagctcttggcgatgattgaaaaatatcgtcgtggccgcgatgtttatgtcgtaggggtcacgaacgttggtaagtcaacgttgatcaatcggattattgccaacaatactggtttgaaggacttgatcacgacatcccggttcccagggaccacgttagacaagattgaaattccgttggatgatggtcatatgatggttgatacacccggaattattcatcccgaacagatggcccacgtgttatcaggcgatgacctgaagttagtctcaccacaacgcgagattcgcccaaagggtttccaattaggcaacggtcaaactttgttcttaggtggggtggcacggttagatattgttgatacgttaaaagcaactgggacggtctacgttgataataacttgaccttgcaccgaacccggaccgagaatgcggacaacttttataccaagcatgtgggtgaactgattacccccccaactggcgatgctgtcgctgactttccaccactagttcgccacgaattcaaagtgacggaaatcagtgatattgtctttgaaggcctcggatgggtcacggtggctgcggatacgcgtgtagcggcctgggcaccaaagggtgttgcagtcttgacgcgcccagctatgatcaacaagcgttgatgagttgtggtcggagtagaatctgattcgcgattatcaaacagaaaattataggagtaaatcaaacttaatggaaaacttacgtggaaaacaaaaacactatttacgtggtgaagcccaccacatgcggccactatttgctgtcgggaaaaacggcttgactgacgaatggttgacccaactaacgggtgcgctggataagcgagaattaattaaagtcaacattttacaaaatgctgatgtgacaacggctgaagttaaagctgcaattgaacagaaaaccgcgattacggtcgttcaaacaattggccgggtgttagtcttatacttgccagctagtcatgaagaagaccagcactattcattggaagttgctaagttataggaggaatgacgggtgcagacggttaatcaaacagcgacaaaagttctgacggaaacggtgacggcaattccgcatcgccgtgttggtattttaggtggcacgtttaacccaccgcatttgggacatttgatcatggcccagcaagttggtgatcaactgggtttggatgaagttcgctttatgccggacgctcaaccaccgcatgtcgacgaaaagaagacgattgcggtggaagatcgtgcgaatatggtccaagaagccattgttgataatccactatttcggttggagacggcggaaatcgagcggggtggcaaaagctatacttacgaaacgatgaagtttttgaaagctaagcatccggacacgcagtactatttcatcattggcggcgacatggtcgattatttgcatacttggtatcacattgacgagctagttaaattagtcacctttgttggtatcaaacgaaccgggtacccaacgacgagtcaatatccggttatttgggtcgacgcaccgttgatcgatattagttccactcagattcgtcaaaaaatcagccatgggcattcggtccgttatctggttccagaagccgtggccgcttatattaaggagcatcatttgtatgagcaaaacgattgagtatactgaagcgattgttccatatcgtcacgaggagctaatggcaaaggttgccgcccagttgactgacaaacgctatcaacactgcttacgggtcgaggagactgcgcggcagttagctgctgacaacggtgttgatgtcgagttagctggaattgcggggttattacacgactacgccaagcaacgcgatgatcaaacatttattcagctcattaagacgcatggcatggaccccaacctggtttcgtatgggaacggggtctggcatggctatgttggcgctgaactgatcaaagatgagttgcacatctacaatgagccaattttgaatgcggtgcggttacacacggtcggtgcgccttatatgactaaactggaccaaatcatctttatggccgattttattgaaccagcccgggacttccccggtgttgaagcggctcgtgaagcgacggccaagtcgttggctgacggtgttcgtttccagattcaacatacactagattatctgattcagaagggtgcgccagtctacccacaaacgttagcaacctataacgcgtgggtcggcggtgtggcccctcaatttgccaattaaatttaagggagagttttatggatagcaaggaacttttacaattaactgttgaggccgctgacgataagcgtgccgacgatatcgtggccttagacgtcgcggaagtcagtttgatggcggactattttgtcatcttatccgcggattccaagcgccaagttcaagcgattgctgataatatcgtggactttgtgcgcaaggccggttcggacgttaagagcgtcgaaggtcggactgcgggcgaatgggtcttgatcgatgccggtgacgtcatcgtgcacgtcttccaaaaggatgcgcgggcacactataatttggaaaaattatggtctgatgcgcccatcgtcgacgttgcacaatgggtaaatgcatgatttatcagacgtttgccgaactttatgacgaactttttgatccagccatgtaccagcaatggctggattttgtccgtcgtgaatatcctaaccaagatggtcagttgctcgaattagcttgtgggacgggacgcttaggggtgttgttagcccaagccggctatcaggtcaccggtttagatttgtcggagaacatgttagcactggcacagcgccatgcggacgaggcagccgtgaccttaccgctattacaaggggatatgctcgatttatctgaaattgggacctttgatgcggttacctgttttgctgattcgttctgctatttgcccgatattacgacagtccaacgtgcatttgaacaagtggctcaacatttgacagcggccggcgaatttttattcgacgtcattacaccttatcagacggatgaggtctatcctggttatatgtacaattatcgcgatgaggatcgggcttttatgtggacaagctatgccggtgaacagccgcacagtgctgagcacgatttaacgttctttatttataatgatgataagcaggccttcgacgaggtcagtgaattacatcaagaacaaacttatgtgttggctgattatcaacaagctctgcaggcagccggttttaatcatgtcacggtcagcgccgattttggccgccaacaaccggatgatcagaccacgcggtggttcttcaagtgtcgtaagtagtaggaggaacaagaatgcaagcagtcgggttaataactgaatacaatccgttgcataatgggcatcgctaccatttgcggcaagcacaacagttgaccaatgccgactgtgttattgttgtgatgagtggtgattggctgcaacgcggtgaaccggccattttagacaagtggacacgtgcgaagctggctttggaaaatggggcggatctagtaattgaactgcccgtgttttttgcaacccaacctgcccatttatttgcacggggtggtattgaactactcagtgcactggactgtacgagtgttgtttttggtgcggaacatcctgagctggactttcaacggttggccacggcaattgcggcgcggcagggcagctttacccactataatgcgacttttgccactcagtttaacgcggccttgcaagctgccacgggcgtgacgttgacggcagccaatgatatgctgagcttctgttattacgctgccaatcagaccctggcacatccgatgcagttactgccgatcaagcgtcgccaagcggatcacgcgacgacgacaattgcggccgatagtcgctacgccagtgggacagcggtgcgccaagcggcacttgcacaggattgggaggcgctgaaaccagttgtcccggccgacacgttcacggcgctgactacgcaacgactgcagcgctggagcgacttttggccgtttttacagtatcaattgctgaccgttgacgttgcccgtagtggacagtatgatcagatggcggaaggcttggaataccggatgcaggcgatggcccaacacgccacgacttttgatgactttattcatcaggtcaagtcaaaacgctatacgtatacacgattgcagcgggtggcgacagccgcactactacaacttactcaggcagaagtccagaaagcacaggcacataattatctgcgcgtcttaggcttcacacctaaggggcaggcttatttgcatcaagtgaagaaacagctcccgttgccgctgtatacgaaaatcaatcaagacttacgccagcatgctctgaatctcgattatcgggcggggcgcgtctatcaattaattaatgggcaatcgcaagatttatatcgacaaccatggcggttaccggtaacaattggttgaccgcggcgggctttcttgatatggttaggtctaatgacgggcattttggactgtcaaggaaaaaacattgacaaaggatttttacacaggtataatttatcacgttgcattaggaggtttttaaatgaaatggtcactttcacagcttaaaacataccgtgaaacgccacttcagtttgatgaagcattggatttaaaacactccttgatgagccgttatccagaaattatcgatgttaagtcagttcacgcaactgggttagcgagttatgataaggataatgtgttaatcacggcgaagattgacgcaatgttaacattgccgtctagtcgctcgctgacgccagtggatgtcccattggcttttcaaatgacggaatattatgttcctcagggaaccgatctgagtcgttttgatgaagaaactgatacggtaattattttacctgaagatgatattttagattttgatgtcgctgtggaggataatattttaattcacatccccatgcagattctttctgaagctgaacaagacggcgccccaatgccaactggtaagggctgggaagttctctccgaggacgaccaagcgttgcaagctgcagaacttaaaactgttgatccgcgtttagctaagttaaaaaacctgttccctgatcaggaagacaaggattaagttagctaggcgtatcaaaacacacattatgtgaattcacttgaaggaggtgtaggttgatggctgtaccagcaagaagaacatctaagatgcgtaaacgcaaccgtcgtggtcatattaaattggctacaccaaatttggcaccatgcccaaattgtggcgaattacgtgtatcacaccgtgtttgcccaagttgtggatactacaacggcaagcaagtcgtaaaagtaaacaactaattgttagttggtgaaaagttgcattgcggccatggcgcatgaaactttttgttaccataatacgatcaaaaagcccgcttaggtgggctttttttgttgtcttcaattaagtttgagttgggaccagcacttcttgaaataaggcttgactgaactgccagcgcggtcaagcgagtggctttgcatattgattgcgatgaggcgtctcccttccgtatactaagactatcaaatatgagtacggcttcataataagtgttactgacgcagcgacaagggggttatggagatgatgagcaaaaaatatgggatcgggttagcactactcaccgtggttctgctagctggatgtggcacccaacagtcgacgcaaaataaggcgacaagccaatcgactagcagtcaaagtagttcgaccaaaagtgtgacagccaaaacgaaagtgtcattagccgcagccatcaaaaagtttcagcaacaatatccggacgccagtgtgacgagtattgagttagaagaccaactcggtcgaccggtttacacgctggaaggcgttggcggcacccaggaacatgaattacaactcaatgggcgaaccgggaaggtcatcagtaagcagtctgagatgctggatcaagatgatcaagctgacgctgagggtgaccggctgaatcttaacaaggtaatcagtcctagtaaagcggtggcgattgccatccatgaccgtaacggtggctatgctagcgagctcaagctcgataaggacaatggcaccacttactgggaggtccaggtacatcaaggaaagcagcaagtcgatattaagattgatgcctatgaaggtcatattttggaaactgagcacgacgattagtaccacgtggttgctggtgaaaaggggcggtatgtagcctcattttgtcagcaactagtcttgaaatggtcagccggctaaacgtatcgcctattttgtaaatcactgatttgatcaatagctagtcgtaatcatcacgtccgtttccatcacaccgaattcttgccacatgatttgattgatggtttcaatcagacgtgtgatttcaatcgccgtcatccgaggtggcacaacgatcgtggctcgcagcatgatgagattaccatcataatgagccttgagaaaaatgactttgcggacactagttaaatcagcaattcgccgttgatagcgatcttcaaggtaagggtcgaaatagtcaactaggttcagactactttctcgaaaaattttggtgccagtattgaggatgtatagccctaagccgatactaatcaggttatcgaaccactgaaggtggagcttgaccgtgacaaggatcgtaagaacggtagtcagactggtcaacgcgtccgtgaaggtatcacggctcgctgcggtcagggcagcattgttaagtttgcgactccaataatgattgaaggcccataagaccagtagcaccacgaaggaaaacccggcggccaagccggcgatactgctgaggtttttgaagggggtacgggtggcgaatgtcattacgcctttgataataatgtcgattccaatggcagccatgatggtgccggctagtaaattaaaaatcgtctcaaaacgaaagcgggattgctggattcggggtcctaattgctgctgctccgcgggtgcgatgggtgcgccaaataaatcgtcatcgtgcgtgcgactggcgatgaatagaccagtcatgagtagcccggtcgaaaaaattccagataaattattaaaggcatccgcacgtagggcctgtgagtggccccagcgtgcccctagaagctcgataataaataagcccaaataaacggtcacgttgccccagagatggtgacgggccgttttaagcgaaatgacaacgggctgttcaatttgatgccaatctggcagtcgttggatcgacatgattaggggcctccttacgcatcttgaattggactgctggtcaggattagtggtgctagggtgtctctctggtaaaagtggccaccagcgggcatgtacgaataaaaaaagtgcggaacgtcagaataacaatgaggacactagcctaaacaccacgaaccgatctatgaaggttatccgtttattttactgtaagcctagcacggtgtttttaactttgtcagttggtgctgtttgaaaggtaagtaacctttttggatggtcctatgaaaattaatttctttccaagataaattatatgaaattaattttaaaatttgcggtcatttactttattaacagcgtgttttttggtacgatagttgcgtattaaaaattgggaggcaataaactaatgagtaatgaaaaaccacaaattggtgtcattgggatggccgtcatgggtaagaacctggcgttgaacatcgaaagccgcggctacaaggttgcgatttttaatcggactggtgccaaaactgaaaaggtcgttaaggaccatgctgacaagcaattagtaccaagttataagatcgaagacttcgtggcttcacttgaaacgccacggcggattatcatgatggttaaggctggtaagccaaccgatgccgttatcgatgaattattaccactattagataaaggcgacgtcttgattgatggtgggaacaccaactttaatgacacgatggcgcgtaacgcccgcttagataaatccggaatcaactttattggtatgggtgtttccggtggtgaattaggtgccttacaaggcccttcattgatgcctggtggtcaaaaggaagcttatgatttagttgccccaatcttggaaaagatttctgctaaagcgcctcaagacggtgcaccatgtgtgacttacatcggcccgaacggtgctggtcactacgttaagatggtccacaacgggattgaatacggtgatgaagagttaatcgatgaatcatacaatatcatgcgcaacgtcgcgggcttgtccgttgatgaaatgtccgatatttttacggactggaacaaaggcgaattgagcagttacttgatcgaaatcaccgctgacattttgtcacgtaaggatgatttaggtgcggataagactaagccaatcgttgacatgatcttagaccgtgggaacaacaaaggaactggtaagtggagttccgaagatgccttgaacgttcaagtgccacaatccgttattacggaagcggtctatgcgcgttacatctcaatgatgaagaacgaacgggttgccgcttctaagaaattagctggcccaaccgctgacgttgacttgccagccaaggaagaattggttgagaagattcgtcaagccctctacttcagcaagattatgagttatgcgcaaggcttcgaacaacttcgtttcgcttctgaacattatggttgggacttgaagttcggtgaacttgcccaaatctggcgtgctggttgtatcatccgggcccaattcttacaaaacatcacggatgcttttgataagaagcctgatttaaataacttattgatggacgactactttgccgacatcgccgccaagtatcaacaatcaacacgtgaagtgcttagcttagcgatccaagctggtgtaccggtaccatcatttagtgcggcattgtcatactacgactcataccgggccgaagtgctacctgctaacttgttgcaagcgcaacgggactactttggtgcgcatacgtatgaacggactgaccgtgaagggttataccattacagttggtacgaagaacaataaaatcattttgaatgaactaaactgtggctaatgacgttacgcgtgattaggcgcagtttttttgtgctgtgggtggctgtgcggtaatgatcgttggtttgagtggattagaacgtacgtttgcgttaaaattgagagtaatgaataaacgcgaaagtgggggtcgccatgcgacaagaatcattatttaacccggataaatctagtagtagtccgttggcttaccgggtccggccagtgacgctggcggatttcaagggccaagagcatctacttggcccgggtaaactattacgacaattaatcgcagaagatcagttaccatccctgattttttggggaccaccgggagtcggcaagaccacgctagccgaaattattgcgcaacagacccagtcgcactttattacgtttagcgcggtgacgagtggcattaaagaaattcggcaaatcatggatgaagcggaggctaatcgagattttggtgaaaagaccattgtttttattgatgaaattcaccggtttaataaagcccaacaagatgcctttttgccatatgttgagcgcggcagtatcacgttaattggtgcgacgacggaaaatccctcatttgaaattaacgcggccctattatcacggtgcaaagtattggtcttaaaggcattgacgcctgacgcattagaagctgtcttacagggcgctttgcagaatccgaaggggtttccggatcttgagattacgatgcagcctgatacactacggttgatcgcagaatttgctaatggtgatgctcgtatggcgctcaatacgttagaaatggctgttttgaacggtgaccgcgatggcaagcacgttacgattactacggccgggttatcgcaactgatcaatactaagtcgttgcgctacgataagcatggcgaggagcattataatattatctccgcgttacataaatcaatgcgtaatagtgatgttgacgcggcgatttactggttgatgcggatgctagccggcggtgaagatccgctgtatatcgctcggcgtttgattcggtttgcgagtgaggacattgggctagctgaccggcaggcattgccactgacggtagcagtctttcaggcgtgccagttgatcggtatgcctgagtgtgacgtgaatttgacggaagcagtgacttatttagccttagcaccgaagtccaatgcattatacgcggctaaatcggcagcgcaagcagatatcaaagcgacgggtaatttaccggtccccttacagattcgcaacgcaccgacaaaattaatgaaagatttaggttatggttctgattacaaatatgcccatgatacagcggccaaattaaccacgatgacgacgatgccacctgagttaaaacagcaccggtactatgagccgactagccagggacaggagaaagcctggcaacagcgcctagctgctattcgccagtggcaccagcaacatccgcaaaccgaaccgtcagatgatgagacataaagattgcaatttaatgagaattcactaaaattagatttgggtgaggagcagaccctggttggggtgtaggaaattcagcgttttcatgttagaataacatgttgtactagcttaatgcaggttagtggtgataaatcactgattcgtacggtttttagataagttgaatattaggagtgactaaaagtaaatgagtcgaatattaattattgaggatgaaaaaaacctcgcacgcttcgttgaattagaattaaaacacgaaggctatgatattcaagtcgaatataacggccgtaaagggttagacgcagcgttagctgaagattttgatgccatcctattagacctgatgttaccggaactgaacggtttggaagtctgccggcgggttcgtgaagtcaagaatacgccgattattatgatgacggcccgtgactccgtgattgatcgagtttccggcctggatcatggggcagatgattacattgttaagccatttgctatcgaagaattacttgcccgcttacgagcactattgcggcgaatcgatttggaaagtgaacaacaaagcactaaacaaacgaccgtcacttataaagacttgacgattgaaaaggaaaacttagtcgttaaacgcggcgacgaagtcatcaacttgacgaagcgtgaatatgaactgttattaactttaatggaaaatattaacgttgtcctcgctcgtgatgtcttactaaacaaagtatggggttacgaatcagaagttgaaacgaatgtcgtcgacgtttatatccgttacttacggaacaagattgaccgaccaggagaaaagagttacatccaaactgttcgtgggactggatacgtgattcgttcttaatgactgacgctgatacgaatcaagtgacgcctaaaccacggcgccgttggtcattaaaatggaaatgggcgctcgggaccgcaattgggtccgcgctcatttttatttgtttttcattattggtctataagagtttcacgaacctcttattgcgccaagaacaacggaacgtggctagtgctgttacaacggtgcaacaatcgttacgaacggagtcgaagggactgaccattaaatcggtggccgctaaattgcaacccgaagcgagcgttgaaccggcaactaccatgagtgaacgtaagcatggtgtgctgcaaagtaaaatcttttcagattctgatttaacagccttatcccgtacaaacttagctgtgacggtttatgatccacacgggaacacactctatctatcccgcaaggatgcacatgagttctctaagaataagacgcgtcaggtggtggtgattggccgaggaagtgatgctgaattagttgggcgggcgcccatttatgcggctagcaatcaccgtttgattggttacacccaggtcaccgataatttggcggaataccattcaacgactcagaatttgatctggatctttattgtgatgacaatgatcactatttttggtgccacgctactgggctatttcttagctgcgtttctattacggccaatgcgtaaaatcaaacagacgattaatgcggtcaatgatgatccgcaaactgactcgcgagtgcccgatcttaaacgcaatgatgaattgtcggatttagcagtcgtattcaatgatatgcttgatcagatgcaacgctatattaatcaacagcagcaatttgttgaagacgtttcccatgaattacggaccccggtggcaattatccagggccatatggagttgctgaatcgatggggcaaggatgatccgcaagtgttgtcggaatcattggcggctagtttgtcagaaaccaagcgaatgcagagcttagttcaagaaatgttggacttatcgcgtgctgaacaattggaaatcaattttagccatgagacgtcggacgttcagaagttagtgacgcaagcatttaacgattttacgatgattcaccccgactttcattttacgtttgatgatgatgttaaaaagccggtgtatgctcagatttaccgtaatcaccttgagcaaattctgattattttattggataatgcggtcaagtactcgacacgacgtaaagaaatccatttatcattatccacggattatcgctacattgaagtcgccgtccaagactttggcgagggtatttctaaggacaatctcgatcgagttttcaaccgtttttatcgggttgataaggcgcgtagccgtgataagggtggtaacgggttaggattatccattgcgcaacggttagttgaaggttaccatggtcatattagtgttgaatctgtggtgggccagggctcgatctttcggttccagttaccgattctacgggacgcgaagctcttagctaaggccgaggctgaaacgaatgatgttgaaaagattgccaagtcggaactgccagccggaatccgaccagctactcgtgatgaagatgaagcgcccttggatgatcatgagcacgaccactaggtaatcgaatcattgatgaatttaaaacgcacattcaagttaatttaacttgaatgtgcgttttcagtatggataattgcgctgtaatgaattttaaagccgcggcctatgggatcatatcgtgattttgagggaggcctggatcaatattgagcatcgactgacagttcgatagggcgcagtaagatgctgattaaacgacgaataggttgtacaccagcaggctgggtttaatcctgattcagattgatccgactcgaaatatatttaagctgaccgatatttgttggtatgttcatcatgaaaccattttcacaagtaaccttttttggtatagtggaagagtagttaatttaatcagggggcgaagttgttgacgaacgaaccaacttatcggccaatgacgttcaaaatttttttggaattcattcggctaaatgccaaggcagctagtgtggtgccgtattttattggtattttattttcaatctattattttcatgcgtttaattggatcaattcgttaatttacttagttgcacaagtagcgattgcattgtttgtgacggggtttaataacgtgcaggattactacttggctaaggatttacattatcgggatacttataacattgttggccgtgagcacctatcaccacgacgatcattgaatttgatgctagcgatgttagcaactgcaattattttaggattagtgctagtcgtcagaacaaacctattgttactgttcatgggcgctgcagcgattggtgtggctatcttctatacctatggcccggtaccgttttcgcgcttcccgttgggtgaattactgtcgggatgtgtcgaaggatttggcgttttctttctgagtgtttatatgaacgtcgcgacccccgtactggcgggctttaagtttgcttggccgcagtttgcgattgtggggaatttagagaacatattggtcatgattttggtggggctaccagggattttcttggttgcgaatatcatgttagctgataatatttcagatttacaacaggatattcgcaatgaacgttatacggttccgtactatattggtcatcgttggtcactacgggtctacgatacgctggcgctgttaggttatttgccagtgctgatgagtgttgttttacaaatactaccgatttatcagctggcagtgttgctcgttttaccaaaaattttgaagaatattcgggcctttaacgcggtgcaggtgaaagaaaccacctttaatacggcaccacaaaatttgatgatgtttcaaggcatgcaattacttggactgatcctgggtattttcttttaatccggtctgattaattgggatggttcacagaaacggcggccgtcatccagcataattgctgaatgacggccgccattttttgtgtcgctgttttttggaccttgttagtcatgtactgcggttgttttcggcggctatttactgatcaaccgcacggtactgtggccatcccccatctttttgatgagaacttgttggccaatcgttcgtttcattgattcaatgtgactgataacaccgaccattcggttttcaccaattgtttcgagtgcctgcatcgctttttccaaagtttcatcatccagggagccgaagccttcgtcgacaaacagtgcgtcgatttggacgccattagccgaagattgaacgacctcactgagcgagagtgcaatcgacagagcagcaatgaaggtttcaccaccggacaacgtgttggatgaacgcgagttgccggtttcattatcgtaaacattgatatcgaggccgtggtcactgcggttatcactcgcttcggcagctagttcaaatgtgtagcggttattggaaagcaggttgataaagtgatcattggcgtagtttaagacgcgttgcaagtagttttggacaacgtaggtctctaacttgagcttgtgatcgttgccatctttaccagtcatgatattatacaggcttgtaatttcggcgaaccgctttgcaaatgtgccttgctggtgcatgatttgttggactttttcgagacaactttgcgcgtcggttaaggcttgttccgccacggtttgggattgcagtgctcgatccttatgagcttgcaggtcggccagctgagcttggatacccgtaatattcggtcgttcaacgttcgttaaggcggtttgcagttgcttgatttcggttgtcagacgctccttgtcttgccgataggtggcaatttggacttgcagggcggtcagtcgaccattggcgagttcttctaaccaattttcaagtacagtttggtcatgagtcggtgcttctggagcagctaaggcctgtgcgattgtttgctcaagctgcgtgcgcgtggcctgtgttgtcttcaaccggtcgtttaaatcatcgagcttagtttgatgttttgataaagtaagttgactggtttgaacggtggcttgggcggcctctaggcgttgttggtaggtcgcgacgatctgattgagatgcgctttttcggccagcaggtcagcgcttgtgacttgtaagtccgtaccaatggctgcctgagctaccgtcaaatcggctgttttattgcgcaataaggcccgttgttcgcctaactgtaactccgtttgttgggcctgtttttgttgtgcttccagttcagcagtatatttctcaatagcttgaaccactcgttgggctgcctcaagcttcttcgtaattgtggcgagttgctcagcgaaaaaagccctgactgcggtcaaatcgtagggtgacttgagtgctagtccgttggtttcaatcaactgttggtaagttgaagttagttgcgtttgggcagtggttacttgctgcgtagcctggtcaacttctttttcagcctgttcgatacgttgttgagttgcttccacttgcttgttggctgccgccagcgcgttttgagcgtcgtcaacggcttgcatggattgtcgtaagtcagcttcatttgcaacgatggttgtgaccggcatctgtgaatgatcggttgatccacagaccacgcagggctggccgtcaacgagttcttgttgtaattgggcaatcattaagctttggcgttgaccacgttgttgttcaaattggacttgcgcattgtgctgattctgttcatcgcgggcaagctgcgcccgtaaatcagtcagttgcttggtgacgcgctgctgttcttgttgcgcacctcgccattgactatcaagtggtgtcagggtgtcgacgaactgttctcgttgtttaatcagcaaatctttagtggcgtgtaagtcatcaatagatggcaagttcgcttgttgggtggtgattttggctgttaatgtctttattacggtttggtgctgttcaaaagtcgccttcagatcagcgacactcggcttgagctttgcgagctgtgcgatgagactttcaacgcgttgcgcttgtggaatcaacgtggccaattgttccaagcgctgctggtgctgatggttagcttcactttggtcatgtaattgttgaactgcagcttgcgcttggcgatagtcgtcctgcgcttgttgcacgttatccatagctgcttgctggtcaagcgtcaattgcttttggtcacgtgtttgttgagtgagggattgcatggtggcttgtaggggctgggcccaagttaacgcgtgcaactgttgcttggctatggtaattgccggtgtttgttcttcaactttagtttgataatcagcttgcgcctgtgtgagccggtcaaattgttgttggcgatcgcgtgcttgctggtaggtcgtttcggccgctttaacagaccgattgattttactagtcgtttgctgtgcttggtcaaaaacactttgacgcgtcgtaacaaatgctcgtagtagtggaattttttgattgtccggaactgcttgaagttgagcctgttcctcatcattccaagttgctgaggctagtgcgacccgcaaatcggcgacaaactgatcaccagtcttgctggcggtttgatactccgctttaagttccgcagtaaagtctgaataaagttgcgttccaaaaatctttttaagaattttttccttgtcagtcgtttttgactttaagaattccgaaaagtcattttgggggagtagaatgatttttttaaattgatcggcagtcaaattcaagatggtcgtgatctcgggaccaacgtcggccggtttggttgcaatgctctcaatctccacgccaccaacgtgatcaacgacagctaatttggccgtactattctttttcgtcagtccagatccttttttcttagctaagtattgttcaggggagcgcgcaatcttatagagttgattgccttgctcaaagtagaaggtgacgcttgtcggttggtcagcgggggcgaactgactgcgcatctctttggctgcccgaccatccgtcccatcattcgtcgtactgccaaagagggcaaaagtcatggcatcgaaaatagttgatttaccggccccagtatcaccactaatcagaaaaatcggggtactttctagcttgctaaaatcaataattgaatgttcgtgggggccaaaatagttcatggctaaataaacgggtttcacggctaatcctcttttcttaagttgacgaaaatctggtcaacgagttgttgttgtgtcgttgagagctggttaccagtaatcgcgtggaaaaattgcccaacaattgcatcaggactcagttcgttcatgttttttgggccactaatggcggtggcttggtggttcgattcgtagtccagttcgacaatggtgccgtagatttgttcgagttgcgcccggacgttcagatgcttactacggtcgaattcctggacggtgatcgcaaaccaagcctgctttaacggctgttgctgataaaagttgggatcaagtaacgtttcccaaggcgcacgcaacgtaaccaagtcagtttgcggctgaattggcttgaattcatgggtgatcgcagtgggtgtgattgtcacaatttcaacacctttgccatggaacttagggttggcttccttgacgttaaatttgacggggctaccggcataacgaattcgatctttgtcgggtgaggctaaccgagtgtgaatgtggcccagcatcacgtagtcgaagtctgcgaataaatcggtggtcagcgtcgccaaaccgcccactttggaagttgtttcacttgttaattccaagtcgtcatctgctttgggtgtaacggtaaaatgagtaatcaacaagtgccgtttttcaggatcaaaggtggcaatgaggtcactaaccacgcgttgcatcgcatcgtgaatggtgtgaatcgccttgacttgtttttcgggcaaaccttgttgctgatagtagacccgcgcgtcaatggggtcaaaaaacggtaacataaagatttgtgccgttggggtctcgatgggcgtgaaggcctcggctagtaacgtattgatatgaaaattattataggctagccattcacgaccgtagttgagacgtttggcgccatcatggttgccagcaatggcatagattggtaggtgatgctcgatattaatagcctgcagcatgtggtcaagtgaagtgaccgcatcggtactcggaacggcccggtcgtagatgtccccagcaatcacgataccatcaactttttcagccaatgcaatcgttagaatttgcttgaacgctgcttcctgttcatctaacaaagaataaccgttaagcgtccggccgatgtgccaatccgctgtatgtagtaacttcatgggagttcctccttgagtttgaattgttaatttccattatcgcatatttacataaaatttcaggtctcgaagtgtcgtctgcccaaagtagattaattttgacgaaatacgtttgatttagtttggaatgttggcggacaaacttggaagtgggcaagttccaccccttattatgcaattcagctataattgcgcttaactagttgagcaattattgattgcaacatacgggtgagtaatttgctggtcatctttgctttcagcgattgcgtgttttagtcacgcataacgtaggactcggtattggaataattatggcgctgcaaccttatctggctagcagtttagaatgggggcttactcatgattccagaaaaatggcaacagacgcttggggttaaattgcttatcatggtaaatttaatcaatttggtcatcttagtagtgattaaactggccagtggtgggcccatgtggcaaattcgtaatgcaccgttggccgtggttggtgggttatttttaattgggattagtttaattttgatctgtaaacagaattccaactggcgcaagggaacgtatctcggtgctgatattaacttgaccgttttattttatttgttacttattgatttcaaccggatttccacgattggctttgcgctgatcgcgataatcatctcgattgtcgcattaccgatggcatatacttctcgtaatcgcttggttggaatccggattccgtgtacctatttgtcagaagaaaactggcatcggactaatgtgctagcaggcagattatttggaatctcaggaccgctgttagtagcgatgggaaagatgtcaacagactcatttctcaatgtctttgttacgattatcgtgttggtcgtgattttgaccgtgggttattcctaccggttaagtaagaaattaatctgatcgggcctggcagcgttaattggcatcccgtggtaatgtttgcgaaatcagttaaggggacggctgtatgccggttaagtgaaacgtaaaaagcaccgccatgagaattttcatgacggtgctttagtgttgattaagcttcagttattatttatgatgtcgttgttgtttaccggcattccgaccacgccccgcattattttgcggacgaggatgactaggcttggattcagttgcactaaccggctttggttgcgtcggtgttggtgttttgatggggtgctttttgagttctgcttcaacttcgcgccgaatacgtggccggaagaagttgatgatcagtgtttgcaagcaggcaaataaaccaccgacgaagaagtaaagtcctaaacctgcgggagcggacatggaaacaaataaaatcatgaccggactcataatgagcatgagacgcatcgtcttcttctgttcttcaggtaaaccaatcatggataggtaaccctgtgccaagtaggataaaaaggctaaaatggctagaatcagactggatttcccaagggagatccccataaaggtcgccttagataattcaggcgaatagcgaatagcgtagtacaaggcggagaaaattggcagttgaatcagtagtggtaaacagccaataccaccagtcatgctaataccgttgtcacggtaaagttgcatgagctcattactgattgcggctttttcttcctgagtcgtcgctgctttttgccgtgcctggattttttccatctgtggccgaaccgcggacattttttcttgttggtaggttgatttacgttgttgattaatcatcattggcagtaaaacgagtcgcacaatgaccgtcaagccgatgattgcccaaccgtagttgttaccgaatagttgtgacaaccattccatcacgttttgccctggctttgcaaggtactcgtaaacaaacccgtatggtttaccagctttggtcgtttgcacacaaccgcttagaaacagtgctaacgtccctaaggtgatggtgagcgtaaggcctttttttgatttcactagttaataatcccctttgttaaagtcatataatgatgatgatactaaagatgtcgggggaattcaattggttatccgaaaatcgtgatagttttgtggttcaacttcatgcacttcgaggtgcttgaccttgccaaaatcggttggcgactgccgaacaacgtcgataaagacttgcactcgttgatcttcaccctcggcttcaataaagactgagccgtccatcaggttacgaacgattccgttcacgccgcatttgtcagcggcaactttagtggcccaacggaagcccaccccctggacccggccgattgcttttaatgttactgcacgcattgtgtcacttccttacttaacttgttcagctagtctaacctgtgactagcatcttgattgtactgattgctgattgtattgtgttagcataattagtacaatctgtattacttatataatagcatggaaatgttcaacgggcgatatgctatacttgggataaaacggacactttcgaatgatacagggtgccccgaattgacaagaccggctgatgtttcaaccgattaattaaaggaagttgacgatggaaaaaattaattcattacaaaatgcgcacgtcaaggcgtggaaaaagctccaaacaaagaagggacgcaaacaacagggacaatacttgctagatggttggcatttagtcaacgaagcagttaaagcacacgtcgcgattcagaccttgctcattactgccaagcaactggcgaccgaaccggacttgactcattttccagcggtcattgaaatctctgatgaagtcgccaaacatatcagtgcgacggtgacgccgcagggggtgtttgcgctggcgaccctgcctgctgcaattgaagatctatcacaattagatttaacgcggccttggttactgctcgataatgttcaagatcccggaaatattggaaccatggtacggactgcggatgctgcgggttttgccggcgtcgctttcggtaccgggacggtggacatccatcaacccaaagttgaacgagctatgcaggggagtcagtttcatttacaactgattagtactgatctcgacaagttggttgaccaattgcaggcgcagggttcaccagtctacggttcagagttaaatccacaggcagcccggtatttagatattgacgcgccggctagttttggcttgatcatgggaaacgaaggtaatggaatgagtcgggaattattggcacggacagaccaaaacttatacattcccatcaaggggcaagcagaatcgttaaatgtagccgtggctgctggcgttttaatgttcggtttatatcgctaacttacaattagtaagaaaatgctaaaatccaggtaaaatactttcaaaatgactgactttttagtagaatagccgtagatattagcaaagggagctttagatgaaaactaataatgcgtggcaacaagattctgaatacgtggcgatcgtcgaagatttattagcacagccggccgttcagcggcttgctgagtttacacagcaccaccattcaaatcgattggatcattcgattgcagtttcatatgatagttatgttttagcgaagaaatggcatctaaatacgacggcagtggcgcgtggtggattattgcatgatttgttttattatgactggcgtgaaaccaagtttgatctcggctcgcacgcatttattcatccgcgggtagcgttacgtaacgctgaaaagttaacgaaattaacgccgatggaaaaagatatcattttgaagcatatgtttggtgcaactttagctgtgcctaaatatcgtgaaagtttgctcgtctctttagttgatgattatgaagcagaacatgaattttttggaccattacgtatgaaagtggccaaacaactagatcggttccgaggcaaggtctccgccggttaattcaataattgggggtcattgcatgtcagaaatgctagctgacacggtaacagaatccaacgtggatttcgaactgtgtccaaaatttgaaaagacgttctcaattctagggaaaaagtggaacggtttaattatcgatgttttactggaagacggtccccaacgctttaagaatctggcacgccggattcctaagtgcagtgatcgggtgctggtcgttcgtctcaaggaattggaagaaaacggcattgtgagtcgggtaacccattgtgactctgccctgattgagtatcgcttgactacgaaggggcaagatttacgacaggtcatggatacggtccataactggtctgataagtggttcagcctggccgaatcctaatacggggttgacgtgcagggcactttgccataaactgacaatgtagataaaagccttgacgagaaatagtagttagttacggcgtcgtagggacgggtgtcaccgattgaaagcaccctggcgaccaagattgacgaattcactctctgagctgaaattgggcgtttgtgtaaacaaataattttccggtatcccgaccgttatgacgggtagtgagtgtgcatagtgactactatgcaaacaagggtggtaccgcgatgacctcgtcccttttcagggatggggtctttttttgtccgcaacgcaactaaaaattggaggcagcatatgagtttacaagatcgattaaccgaattacgcgatcaaggcttggccgatattaaatccgccgatgttttgaaaaaggttaaccaagtcaaagttgatttgcttggtaaaaagggtccgattacagaagtattgcgcggaatgcgcgacttaagcccggaagaacggccaaaggtgggcgcttatgccaacgaagttcgtgaccggattcaggctgcgattgatgaacgccgtgaagaactggaacaagcagccgttaatgagcaattggctgccgaaaaactggacgtgacgttaccgggtcgggaagttccacaaggtcagcctcacgtgattacccagattattactgaattggaagatctatttatgggaatgggctatcaaattgttgatggtgatgaagttgaagaggattactacaactttgaacggttgaacttaccgaaggaccatcccgcccgtgacatgcaagacacgttctatattaccaaagacgtgctactacgcacgcagacgtctgctgatcagccgcggtcacttgaaaatcacgatttttctaaaggaccgctgaaggtcttgtcacctggccgcgtttatcggcgtgatacggatgatgcaacccattcccatcaatttcatcaaattgaagggttagtcgtggacaagcatattacgatggctgatttgaagggcaccttaattctggttgccaagactttgtttggcgatcaattcgatgttcggctacggccaagcttctttccattcacggaaccatccgtagaagctgatgtaacttgctttaattgcaatggcaagggctgtgcaatctgtaagcaaacgggttggatcgaagtactgggtgccggcatggttcacccccacgtgttagaaatgtctggcattgatccagaagaatatggtggttttgcctttgggttaggaccagaccgctttgcaatgttgaaatacggtgttgacgatatccgcaacttctacttgaatgacgtgcggttcttgtcacagttctataagaaaggttaggcgtccacatgagaatttctacgacatggttacgcgattatttgaagctggacattccggccgatgaattagcagaaaagattgaacggacggccgttgaagttgacggtgttattcgtcccagtgaaggattgaaaaaagttgtagtggggcacgtcttaacgtgtgagccacatccagattctgatcatctccacgtttgtcaagtggacgtaggcgaatcagaacccttgcaaatcgtttgtggggcacctaacgttgcggctggcgaaaaggtgatcgtggcgttacccaattcatggattggtggtcacactaagatcaagaagagtaagatgcggggagttccatcaaatgggatgctgtgcgccttagacgaacttggttttgatgaaaagttagttcccaaagaagttgcggatggtatttttattctgcctgacgatgccacgccaggtgatccggtcttttcatacctagggatggatgatgaaattattgacatgtccgttacccctaaccgtggtgacatgcttagtatgaatggtacggcgcatgaacttgctgccatttacgaccagcaaccaacgatgccgaaagttgatttgcatgaggatgctacgacggtggctgcggatgatctacatgtggctgtcgctgccgacgaacatgatgtcccaatgtacaaaatgcgtctaattaaaaacgttacgattaaaccaagtccgttatggctccaaattcgaatttggaatgctggtatgcggccaatcaataacgtcgttgacgcaacgaactacattttgatgcaatatggacaaccgctacatgcttttgactttgatcaattgaatgacggtcaaattaacgtccggttggcgaaagctggcgagcatttaacgacgttagatggtgaagatcgcgaattactagcgagtgatctgttgatttgtagtggcgatcaaccaatttgtttggctgggacgatgggtggcctagcgaccgaagtcactgatcagactacgaccattgcgttggaaggtgcggtttttgatgcagttaagattcgtaaaactgcccataatcatgacttacacagcgaagcttcaatgcgctacgaacggggcattgaccacggcatgactgcaacggccttagacgctgccgcagccatgattgcagaacttggtgatggtcaagttgctagtggtatggtcatcggtcgtgatgaggatgtgcaaccaacgacagtaaccattgacttagcacggatcaaccacgtcttaggaactgagttgtcattggacacggtcagtgatatttttaaacgattggactttccaacggtcgttgctaatgaaacgttcacggttacggtgccatcacggcgttgggatatccatattccggctgaccttatcgaagaaatcgcccggctatacggttatgataacttaccagcgaccctaccaacgggccaaccaacaatcggtaagcttaatgagacccaacaggtgattcgtgactcacgtaagttaatggaaagtgctggcctcacgcaagccatcagttactcattgaccacggagactaagtcgaaggcctttgcgcttcatgctagtgacgtcactaaattagactttccaatgagttcagaacggaccacgctacgcttgagtctagtttctggtttgctggatgatttagcttataacaatgctcgtaaggaacacaatgtggcattgtatgaagaaggacgggtcttttacagtcaacctgaacaagtccggccgaaggaaattgaacacattgccggagctattacgggttccatggttcccaagagctggggcgttgccgaacaacccgttgatttcttccagattaagggtatcgtggctggttatctgaagagtctggcgttgcaagatgccgttagttacgttgccacggccgaacatccagagatgcatcctggtcggacagctgatatttacgttggtgaccagttagtcggtttcgtcggtgaagttcatccaacgactgccaaagcctacaagattcgggaaacttatgtctttgaactggatttaacggcgttgattgccttaccaaaagcgcgtcaacagtatcaaccgatttccaagttcccaagtatcacccgggacgtggcgatgttgattgatgacgatgtgaccaacgcaaccgtggttgccttgatcaacaagaagggcggcgcgcatttacggcacgttcaactctttgatgtttataatgggagtcacgtgccagcgggtaaaaagtcgctagcttatacgttaacgtatcaagaccaaaacgcaacgttagtcgatgatgatgttacgacagcatttgaaaaagtactgacagccttaacggatgaattaggtgctgaaattcgttagtttgttgatagtcttgttaaacgccgaatgatttgaagtcattcggcgtttaatgtgtgtccaagatcctaaaaaaccataaaactaatggcgaactagtgcaaactgggcaacagttttgtataattgataagattaatcaataaatggaggggcgagtcttgaataacaaccaggataaccaagatcagaaggatcaaaacgattcacaagatcgtggggtaaatgaacctaatcgttcagaacaaaaacagcggaaatcattttcgaaacacgttattggtggcgttgttggtattttagtcgtacttttaattattgtgggggtattgggttatcgatattttgataatgcgacgcaaccatatgacagtagcgacaatcgcgtcgttcaagttgatatcccgtacggtgctaatggtaagaaaattgccgatattttacagcgcgaaaaggtgatcaagagtggttttgtctttgaatactggacgaaagcacacaacttatcaaactttcacgcgggctactatcagttgaagccttcgatgtcacttgctcaaattgcgaaggccttgaataaaggtggttcatcggaaccggttcagagttctagtggtaaagtcctaatcgttgaaggtagtcagattaagacgattgcgaagacggttcaaaaacaaactgatttcacgtcggcagaatttctagccttaatgaaggatcaaacattcatcaaatcattggccaagaagtatccacaattgttgaattcagcgatgagtgctaagcaagttcgctatcgtttagaaggctatttgttcccggcaacttatgttgttggtaagaaaacaactttgaaacaattagtaacgcagatggtttcgaagactaatgatgagcttgaaccatactacgcgcaaattaagaagtcgaagatgtccgtgcaagaagtaatgaccttagcgtccttagttgaacgtgaaggcagtacgacgaaagatcggcggttgattgctggcgtcttcttgaatcggttagatgctaagtggcgcttggattctgatatttcagtgttctatgcgatcaattctaacaagtcaacgttaacgaataaagatttgcagactgattcaccgtataacttacggttgaacttaggctacggccccggaccgttcaacagtcctagtttaacatcgatcaaggcagtcttagatcctgcacaacggagcaagggttacatgtatttcgtagcagatttgaagactggtgatgtctattatgcaaaggatgctgcgggtcacgcggcaaacatcaagaaggtttcgaagcacaacgaagccgctgaaaaataagaatgaggcgtaacttaaatgactgaaaataaacatcgccgaccagtagtcatcggggtaactggtggttccggtagtggtaaaactacggtcagcaatgcaatttacaaccaattatctggtcaatcattgttgatcttacaacaggattcctattacaatgatcaaagtgaaatgacaatggctgagcgccatgccgttaattacgaccacccactggctttcgatacagatttgatgattaagcaaatcaagcagttgctggcctatcaaccaattgaaaagccggtctatgattacgagcagtatacgcgtagcgacaagaccattcatcaagaaccgcgtgatgtgatcattgtcgaaggggtattgatcctagatgatcagcgtttacgcgacctgatggatattaaggtgttcgtcgataccgacgatgatattcgaatcattcggcgcattcagcgtgatatcaaagagcggggccggacactagactctgtgattggtcaatatttggcgacggtcaaaccaatgtatcatcagtttgtggaaccaacgaaacgttatgccgatctaattgtgccagaaggtggcgaaaatgaagttgccattgatttattgacaactaaagttcgttcaattttataaaaaataacgtcttaaccagcgctattttagatttaagagtttacttttaaaatctgaaatggtaggctggtttttgataactatattgcgtatttgaggagtgaaacacattggctgaagataagacatatccaatgacagaagaaggcaaggtcaagctggaaaaagagcttgaagaccttcgaattaatcaacgtccagaaattattaatcgtattaagatcgcacgtagctacggtgatttatcagaaaactctgagtatgaatcagcaaagaatgaacaaagcttgctagaaaaccggattaagacggttgaacacatgcttcaatatgctgaaatcatcgatagtgacaagattgacgaaacggaagtctccgttggtaaaatcgtgacgttcaaagaattacctgatgaagaaccagaaagctacaccattgttggtgctgccgaagctgatccaatggttggcaagatttctaatgattccccgatcgccaagggcttgattgggcatcacgttgatgaagaagttgccatcaacattccagccggtaccatgacggttaaaattttgaaggttgaaaacgcgtaattttatgcttaagactgttttgaggtagaggataccttgaaacagtcttttttggtggtttagaagcgcgattactgattaccagccactatttaacgaacgttactgaacaagcacgtttgcgtatgagttcggaattcaagcaaaacacccgcttatctgcacaaagcaggtaaacgggtgagtaaatcggacacgttacaattttgttgagcatttactatgatgaaaacatgccagttggttgggttactgctcatcagcacttgcacgtcctattccgacctccggggctgaggattagcctagctagggcgttaagcggtgaatttccgcttggcgtcatagcgtagctaaccggaagtctcagcctgacccgaacacgtttcaccaatatggcgttaaagcgtggaagaccagtatttaagacgtggtttgtggcttaaatctttgtccaccacgtttcagcaattggcagagatgcctggaagtcggtgtaggacgcgctcaaccaagcaagtctatacgaactcgacttttcccagtgggtccatagctggccctttttgaacttaaaaactggcatgttttaatcatgattcatgacagattgatcaggatatggccgacagtaaagtaggattagatatagataattcgtaattcaccaagcgagacgctgccggttagtatgacacccgggccagcagtggtcggtgtacctgtcgatgagatgtggcccattgagttgctgagattttcctgtagctgccaagtttgagggaggtataactcaaggctacctaatgaaacgtcgacattgatggttgctcggccttctttgatgtcagcgtcatcgaagtagattttggcaccagccattgatacgttcagatccgcagaacgaaaattttcgctgtgaacgtagcggatactgttgcctagtgagagatctaaattaacatggtcatcgttgattgtgctcgttgattcatggacgtcatcgtggttatgatgattgtaatgagcatgatcatggttgtgatagcgataatgatattgataacggggatgaatcaaaagacccaaaccaatgctgagtaatacggcagcccctaaaattgtccatggtacgagcttagtgattccaagtggttgcgcatagatcatggttaagaatgcgatagcgaagacgacgcccggcatattcaagtaacgaaggctactaattaaagccgcaactagaatcaatgttaacaagagactccagatgctgacgtggagcgtgaagagaccgagttgactaacgataagaacaacggcgctggcaattaagaagacgggccaaaaccaatttttatgcatttataacagtcctttctgttcaagacttattttgagttggcgatagtagcgtcttgaagcgtacagttgtttaggtgagtggtgaaacgcaatcaagttcccggtcaatgtcttggtcaaggaatagacttgtttggtattgacaatggcagatttggagacgcgaagaaagtaagcaggtaagcctgtgcccacagcggtcagcgacttgggaacacgataaacattatccagcgtatgggcggcgacctggtgaccagttgcttcgatgaataggatcgaagtaagcggtaactgtacgagttgaccacgttgtgaaacggttaacgtagcggcctcaattgaaagatttttgagagcagcagtgagggcggccgtttcggggtagtcgactggaacatgcagtgtgacggttggaattgaggtgtcgggctccgtttcaatgttcacttgcatgggtttcacctccttaagtagtttaagtacaccacaaaacaatgacgctgtaaataaagactcccttagcggtcatttcaggaacgcaactggtcattggcttgctcatcgactgtcaatgttgcgttttatgggcaaaaagggcacaattactgtaaacgatttcaatgatgaggtgttagtaatgaaaataacaattacagatttggccagtaagtggtttcatgatgacatgggtgtaaccactggtaatggggtgcgcttttacggcaaaacttatggcaagacagcagttcacagtggcttctcaatcgggatcatgcgtgatgacgaaccccatcaaccgattgccatggttgaaaaggatggtgtcaattactatgtcaacgaccgtgatgaatggttctttaagggctatgatctcacagttgattatgatgaacaaaatgacggcccgaagtatgactacacgcccaataacgagtagttctggtgagtgcttgccaatagcgattaatatttggacaaaaaatcagcgttgcctgaattaacaattcaggtaacgctgatttttgctgaccacatctttgactgtgaactgggctaggcgtggtggcgtcgacgccggacgataaaccaaccagccgttgcgagtgcactaatcccagtaatcagactaccagtgattaagaatggcggtcgatacgtcaaggtgaccgtatgcttgcccttacttaatgggacagcaacaaaggtattaatcactttcttagttgcgacggattttccatcaacagtggcatgccaacccttggagtaaggaatggtcgtcatcaaaacttggtgacgatgcttgatgttgattgtaccagtaatcttacgacttgagtgggccgtgatgttccaaggggattgctggagtttctgcgccgacttcttgaattgggtattatccaacttgtagagggtgaagttttgtaaccagagagaagtcttcttcatctgaatcccgaatgtcacggtcttgcccttgctattcgatgcaacgttaacagcgatcgtgtgccggtaagttgggtactgcttgagttccttaccgttaatgtagtaactcgcattcgaagtagttaggttttgcccgagcgtgatgtagtaggaatcattggttgtcggcgtgaacttaaagtaaaccgattccgttttcgctaaattttgtttgttcaagacggcgccagttaacgtcgtgaccttcttaacgttttggaagaccacttcgttaaagttttcggcactgatcaagccgctggttgaacgatttgccaaggtttggtaaatcaactcttgccgggcaatcggatcgccagttgttttggagactttcaagctagtaatcttgtcagacgctgcgaaaccaagacccagggcgtatggatttttgtaggtcgtgactttgttagtgctgagctttgccgatttttggtaattcgtcagatctttcttggtactggtgaccggaatgtagctacgatagttcgcgttatcagtctgggatgtcggtactgttttatccataaagtactgcatgtccagtaacgaatcggtaatcatggtcccgttggtgtaggcgaccacaccgtccccatccggctgaccaattgaaccgaaaaagttagggataatactttcgaaggtcgaactgaaatgatcagcaccgttataggccgcctgcatcggatcgtctttagttcgtgtaaacgtcttaccaattcgataaaaacgattgttgctagctttaattttgttgacggcattgtcaaggacttgcgtgtatttaccaaactcactttgtgacacgtaggaaatattatttaatgaagcgaccacgttgatcgacatatcagtcgcaactaaaattaacgcgacgatttgataaatgagacgtcgttccttaggcaacgttaagaaaatcaatgtaattgctgccaagccaattgtaattaagagattagcttgggtgacgtaggtgactttcttaatgttcaagtaaatggttgtaaacaaaccgaccagcaatgcgagcatcgttagcgcttgccacagtttgatcgttattttgtctgtcagtgcttgggcaccaatccagacgacccagaaacaaaagacaaaggagaagcggtaagggtaccaaactggaaattggcccgcatgccacaataaatcaagtggttcgtaacaaaatgataagataagcgtcgcggttacaatcaaggcgctcaacttcacggaccatttgaactggcgccgtaagaagaagagcacaaaggcgagaactgctaaccatgccacgtaaaagttcggttgaccggatggcatctgatcgaagttgaaagtaccggtgacgaacttagctaacatcttccagggcgcgtattcaagtttccaatgaaccttggtcacattatattgagccttactttgaatgagcgcccagaaagttggtaatagcaaccatgcggagaatgcgacacctagcagaccaccccaagcaaatttgagggcgtgagttgctaaggtcttcacgttttgccaatacttagttgcaccatacaaccagtataaacaactgaataaaatgaccatgtagcccatataatagttgtcaattagcatgacggccagccagccagcgaagtaacggactttaccagttgtaaacaagcgttccagtcccaaaatgaccaatggtaaaatggcgaccgtgtctaaccagatcatgttgagctgattggcgaccatccagcccatcagtgcatatgcggtactaaaagttggcaccaaccaacccttttgcgtctgcgttttagttagtagccaggcgaaggatagccctgcgaaaccatactttagtacagtgacgataaaaatgccggtagtgattgattgaccagggaatagtaagtagattaaattaaagggactcattaagtaataagcccagaccccaaccatctcgccaccaatcgttttggagaaggaatagaagaaagcactcggatcgtgcagtagggtatgccggaaataggaaaacaagtcaacgtattgttggcctaaatcgaccgttaacagactgcttgatccaaagggagccatgtgccgataaataaaataaccggtcatgatcagtaaaggtaaccaaaagctgatccataatggccatgtgcgcttgtcaaaaaaacgacggagtttcaaaaattgccacctcaatctctaataattcacagccaaacagaaaaataatcaaaaaaacattaaaatccgtaataacggctgaaatttttatgtctatcgtttagaataacataagtatggtatttatctaggattgctagtatcatctggtaaatttttgcgaaatgtttaccaaattaagaatgggagcgcctgagaattgaaattgtttaagaaaattacgataaatcgtgatcccaacaagtcgcatattccatttcggctgaacttcttgtttttcatcgtcttcttgttatttgctgcgttgattgcgcagttagcttacttacaagttgactacggacagaagttccgaagtacagtgaattcagccaataatacgacggcaacgggaaacgttcaacggggatcgatttatgattcaaccggtcgggtcttagtgggaaacaaatcccaccaagcgattcaatacacgaaggggctgtcagttgcgtcgactaagatgtacgaagtggcgaataagttaggtgagtacttaaccattccaacggatacattaacggatcggaacttggctgattattacttagcgggggcggctaatttaaagtcggttgctaagaaggttaaaacgtctagcgacgatgatgttttgtacgcacgggaagtcgcctatgcggaaaaacatatcattaataatttaacgtctacgcaaaagaatgcggcggcgatttattataagatgagttcggcgtactcgctgtcaacggtcaatatcaaatcgactggtgtgacgagtacggagcttgctgaaatcggtgagcaccaatccgaaatgccaggagttaaggtcggaacgagttggactcggagttatcctaatgggactgacttgagtagtgtgctcgggacagttacgaccgaaaagcaagggttaccgagtgatagcattaaaaccttgctggcagaaggctattctcgtgatgattcggttggtcaaagccaattggaaaagcagtacgaaaatgtccttcgtggaaccaagtcacagactgaggtcaagacgcaggatggggtcattcaaaaggagattaagaagtacggtggccagaagggggacaacgttcagctgacgattaattcgaagttccagaaaaaggttcaaagtatcattatgtctgaagccaaaacggtggggagtagtaatgcctactcgccaggagcctatgctgttgtaatgaaccctagcactggtgccatttatgcgttagcaggtgccagccggaatctatccactggtaaagtgactgaaaatgcgttgggaaccatcaaccaatccttcgttatggggtcggtcgttaagggtgccacggtcatgggtgccttgcaagatggtgtgattacacccacgaatagtactttgaccgatacgccaatcaagttagccggaacggccaccaagtcgtcatggtttaacaagaatggtggaactagtctgagtcttaacgcttcgactgccatggaagtttcttctaactcctatatgatgcaattagccatgaaggaaggtaacttcagctatgcgtctgggaaagccttgacgatgtctaattcggtcttctctaaacttcgtggttattttaacgagtttggcttaggtgttaagaccgggatcgacttgccgggtgaagcctcaggttaccaaggttcttcggcacagaaggatattggtaaagcgttagacttgtcctacgggaactacgatgcttacacgactattcagctggcgcaatacattgcgacaatggcaaatggtgggcaacgcattgcaccacacatcgtttccgctattactgggactaaatctaacgggtcccaaggggctgttaagactaatgttaagccacgtgtcctgaataccattgacgtcccatcctcatactttgatgtcgtacaccaagggtattgggatgtggtccatgggagtatgacgcagcggacggggagtgcactagctagtttatcaccagcggttgcagctaagtctgggactgccgagacattccacggaacgacatctactgaaaccttaagtttggtgacttatgcgccttataagaaccctaaagtagtgatagcggttgcctttccaggaattactgctactagtggtgattataatatggtcgttgctaagcaaatttatgcagcgttctggaagtattataacaagtaaaaaatcagcttttttcgtaccagtatcttaattgatactggtatttttcaatcattaatggtatagtagttcaagttaagggttccggccctgtaatatgcgaatgagtttggagggtcaacaacatgcgggtacacattacacttgaatgtacagaatgccatgaacgcaactacttatcttcaaagaaccgccggaacaatccggaccgggttgaatttaagaagtattgtccacgggaacacaaagtgacattacatcgtgaaacaaaataacaacggggactcctgttgttttttctgtaacattgtcatcagacaatgggtttctcatttgttggcaactgccaaattgatttttcaatttgacatgttaatgaatgagatttttttataccaattttattttcgggggtgccgtacgtggagaaaaaagcatttcgtaagcaacagcttgggcgattaagccaaatgacgccggctgaccggcaacggcaaaaccaggcgttacagacccaattatttgcaagcccaacatggcaaactgcccaggtcattgccatgacaattagtagtgacatcgaagtagcgacgcgcccacttattgaacaagcttgggcggagggcaaaatggtggttattccaaaaacgctgccgcatcgtcaaatggctttttatccttaccaagcgactgatcgacttgagcgaacgacttttggaattccagagcccgtcacgggtgaaccagtcgccaagcaacagatcgatctgatcttagttcctggtcttgggtacagccgtgaccggcacgcccggattggatttggtggtggctactacgatcgttacctcgctgattatccgggtaagaagttgacactggcttatgacgagatggcttttgaacacgctgaatggccggttgatcaatatgacgtcttgttagacgaactcttggtagcaggggatgaacaacatgatgagaattaaacgctggtggcaaactgaaccggctatcacgcaggtgctacttggaattactgtggcagtcttcttagtcgagtggctgatgggcgacggcgccatgctgatttttaattcactaggtgctaagaacaatcaagcaattgcggccggccagtggtggcgattggtgacgccgatgtttttacatatgggacttacccatattgcactgaatggtgtcgttatttattttatgggcatgcaaattgaagcaatgtatggtcattggcggatgatggcaatttatattttgggtggcattagtggtaatattatgagtttcgcgttatccaataatcagtcagtaggggccagtacggcgtgtttcgcactctttggtgcctttttgacgattggggaatcgttctgggaaaatccagtgattcgccagctcacgaaccaatttttactactaaccgttttgaatttagtattcgatatgttctcgaatggcattgatatctggggacatgtcgggggtctagttggtggctttttgttaggctatctgctgggtgtaccacgaattggcaagattgcgccgctgaaacgaattgtggcaacggttattctagtcattggctggttagctttactaaaaatgggttttacaaatgctaatttaactgtataattaatcgaggatatgcacatgaaaacactttacgacgtccaacaattacttaaaaaatttggcgtgtacgtgtacgtaggcaagcgaatttgggacattgagttaatggccattgagatcgatcatctctatcaagctggtgtcattgacccgaagatgtatgcccgcgtcaagctcgtattgagccatgagcaccggatagaagcagaacgcgcccgtgaaggcgcggcgcatgactaatggagggatttagcaacatggagcgtaagttaatcggagtcgaccttggtgggacgacaactaagtttgccattttaacagaaaatggtgatattcaacaaaagtggagtattgaaaccacgattttagatgaaggggcccacattgtgcctaacatcatcgattccatcaaccaccacattgagttatataagatggaccgttctcaatttatcggaattggaatggggactcccgggaccgttgatttggataatggtacggttatcggtgcctacaacttaaactggaagaccttacaaccagttaaggctcaaatcgaaaagggaactggcatcaaatttacgctggataacgacgctaacgttgctgcacttggcgaacgttggaagggcgctggcaaaaacggtagtgacgttgtctttgtaacgcttggaactggtgttggtggtgggatcatcgccgatggccgtttactccatggtattgccggtggtgccggtgaaattggtcacgtaacggttgaaccaaacggctacatgtgtacttgtggtaagaaaggttgtttggaacaatacgcttctgcaactggtgtcgttcacgttgctcgcgatatggcagaagaattctctggtgcttctaagttgaaacaattattagacaacggtgaagaaattagttcaaagatcactttcgatttagctaaagaaggcgatgtcttggctaaacgcgttgttgatcgggtttcttattacttaggcttggcattagctaatgtcgggaacacgatgaacccatcttcaatcattatcggtggtggggtttcagctgctggtgatttcttattagatcaagtcatcagttactttaaccaattcacattcccaacgattcgcgacacgactgctttgaagttagcggtcttaggtaacgacgctggtgttatcggagcaggttcattggcccaacggtttatttaagttaaaatcaatcgtcaagaagcttggaagtaatgtccgagcttcttttttatactaagctccaaaaactgtgctgattaggttgtggttaaaaactgagcgccaattgccgatgctgatttgggctcatgtcctcagactatgcgcgattttagtttcatgtcggtatgttgttgtaacggcgtatgaactgttacacgatttggcacaagggatacgaatcgactagcgtgaattgaattagatgacagaattgattggagaagcaggatggtaaagttattattgtcttcacgggcgtttagcactgtggccgtaacggacgcctttttcactttagtggcgccggtggctaagaacagtgcgagaattgtgattattgtcaattcggtcagcacgggtaaaaatcacccccaaatggtggcactacaacaaacggttcagcagcttggatatgcgcacgtgcagctcctagatgtattgacggatgatttggccgcattgaatacggcaacggtcattattttgaatggtggctacgagtttttactgttgaagaatctgcgtgaaacgcacgtgctggaacgactgaggactctcgcgctggcgggcaagccaatctacggtattagcgccggggctatcttgttaggcccggatttagacctgtacgcctatttatacccggaggacaacaccgagcaactggcaagcacaacagccatcaatgcgacgacgatccgtatttatccgcattatgatgttcattgtgaagtaaagccgcaattgccgcagttgatcactgactgggaacataagacgggcgttacggtcaaacggttgactaacaatcagggattactggtgcatggtagtcagattcagatgatcgattcagattcataaatgtgataccgcgatgcttggttttgaattaacagcgtggttaaatgcgggtctcaggcccccgaccgttttaatggatttctttaaaccgtgggtgagtacggccataaagcaatcagtgggacttcaggattagtcagcagtttaatcgcggcttttcctgcttacccctagtaaaagtaagcggttttgtgtaaaatagataagtagaaattaggagggataacgtggttttaggtgcattgagcggcatggcgtatgttaacatcgtgttagttatcataatcgcggcctactttatttatgagttgtatagttacattcgacggcgtcaagtgtccacgatgttggacgaagaagcgtttcaggcgggaatgcgtaaagcacaagtgattgatttgcgtgaaaagaaagagtttgacgctggtcatattctgggggctcggaatattccgttcaacagtttgaaagttcggatgaacgaacttcgcaaggatatgccaatctacgtttacgatcaaacccatacgttaagtacacgggccgtcgtcacattagctaagaatggttattcacagctatacattttaaaacccggttacgcacgttgggaaggtaagacgaaaaaagcgaagtattaaaaaatggcggctagaacaacaacttgttcggccaccattttttatttaattaaccgttgtgagctgagcgactcttgcgcatcgcctttttccggttttcttcgaatttgttttcttggtcttcgattggatcaacaacttgcttcttaaatgataagacggagccaattacggcaccagcagttgcgacgaccccaaacaagaagccacgggtaaatgatttcattagtaaaacctcctagcaattgttagttttattatgcttgttttatgcggagatagcaatcaattcaatctgatttttaaaaaagtggggtgaaacgcaatgcttactcaaattattgctcatcgtggtagcaaggggaccaggccggaaaatacgttaccagcgtttattgcggctatcgaggatggtgcggatggcattgagactgacgtacacttgtcgcgagacgggcaactgattattatgcatgatgagctcgtcgaccgcacgactaacggaacgggtcggattgtggatcacacgttggccgagttaaagcaattggacgctggtgttaagtatgcatcagcctatgcgggaacgcgtattccgactttagatgaagtggttcaattattgattcaatacaactttactggtatttttaatctagaaatcaaaactaataagattcattatgaggggatcgaagacttggtagcggattattttaaccatcatcaagttccgtttacgctaatttattcgagcttctacggaaagtcgatcgaacggttgcatattttacagcccgaggtcgaatcggatagcctgttcaagactaaggttcaaactgcgaagcggcttcatgcgcaacacattgttctcggttatcatccggatattcgttgggtgcgagttcactggctcttattgccaaaagtgcagttgcggccatggacggtcaacacggaacgcgatatgcggttctgttatcgtcatcggtttgcgggactgattaccgactaccctggattagcacgaagaattcgtaagcaggtacaaggaggttaaacgagtgacaacagtaactaaacataaagtattactaatcgcgggaccaacagcagtcggtaagacggcattatcgctagcgctggctaaacagctgaatggtgaaatcatttcaggagactcaatgcaggtctatcgtcacttggatattggtacggctaaaataatgccggaagagcaggcgggcattccccaccatctaatcgatatcaaaaatattgatcagcgttttacagtcgctgaatttgtcagtcggacgacggcgttgatcatcgatattagtgctcggggtaaactgcctattattgtgggtggaactggcttttacttgcagtccttgttggcgggctatcagtttggaccagcggataatgaacctgatatggtgtatcgtcaagcttggtttgatcgtgccgctgtcgaaggttcggatgtggcgtggatggcgttgaaacagcgtgatccgcaggcagccaccgcaattgcgcccgctaacttggtacgggtcgtacgggcgttggagtacgtgcatacaactggtcagcttttttctgagcaggcggatacgcacggtgacacactggatgcttataccttatgtctgaccgcggagcgagcgctgctgtatactcggatcaatcaacgtgtcgatcaaatggtagcggccggattggaacaagaggcgcggtggctatttgaccaaggtggcgccatgttaccggctggtaaggggatcgggtatcacgaatggttcccttactttaatggggagcagacgcgtgacgaatcaattgctaagatcaaacaggactcacgtcgttatgcgaagcgtcagttgacttggttccgtaacaagatgtcggtcgactggatcaatctattggaacaccctgaattacgggtctcgattgaccaacggctagctagttggttaagctaaattataaattggtatacctatgataaaacgtgtgatattttctaacatgaatgattgacattcgatgataacattgctaatattaagtctgtattaaagaggagggtcgttatgaaggaaaaggaactccgtcgctcgttggccgtcttgccaattggtacggttatgaagctgaccaatttgtctgcgcgacaaattcgctactatgaagagcaagaattgattacgccggaacgaaatgccggtaatcggcgaatgttttcgttgaatgatgttgatcgtttgcttgaaatcaaggattacttagcagatggcatcaatatggctggaatcaaagaaatatatgcgctccaaaaacagcgagctgagcagaagcaagctgacttggctaagctgctaactgatcgcgatgtgcgccgaatccttcatgatgaattcctgaatctcggaggcttgcagtccgacaagggccccaattatccggcacactaagatgtttgcattcgttagtcaatcaatttaaggagcgattttcatggcaaaacagtcctactcaaaagacgatatccgccgcatcgtcaaagaagaaaacgttaattttttacggttaatgtttactgatctattcggcacaattaagaacgttgaagttccagtttcacaactcgacaaactcttggataacaagttgatgtttgacggttcatccatcgatgggtttgttcggatcgaagaaagtgacatgtacctgtatcctgacttatcaacttggttgatcatgccttggaacacggaacatggtaaaattgcacggattatctgtgaagtttacacgtctgaccgtaagccgttcgaaggggatccacggaacaacttaattcgtgtcttgaacgatatgcgcgaagcaggttatacgtcatttaactgtgggactgagcctgaattcttcttattcaagatgaatgaaaagggtgaaccaacgaccgaattgaatgataagggaagttacttcgacttatcaccaatggacttgggtgaaaattgccgccgggacattgcacttgaacttgaacgacttggttttaacgttgaagccagccatcatgaagttgcacctggtcaacatgaaattgactttaagtacgcggatgctttatctgcagccgatcatatccaaacgttcaaattggtcgttaagaccatcgcacggaaatacaatttgtgggcaacctttatgcctaagccgttaaacggtgtcaatggttctgggatgcatgtgaacatgtccttgttccatgatcaaggcaatgccttttatgatgctaatgataagaatggcttagaattatcatcagacgcttattacttcttaggtggtttgatgaagcatgcccggtcatacactgctgtcactaacccgacagtcaactcatacaaacgcttggttcctggatatgaagcgcccgtttacgtggcctggtcagcatctaaccggtcaccaatgattcggattccaagtgcacggggcttgtcaacgcgccttgaattacggagtgtggacgcttcaactaacccatatttggcctttgcagcggttcttgaagctggcttggacggaatcaagaacggtattgaaccaccaaagagtgttgatcgtaatatctatgttatggatgaagatgaacgggctgcagctggtatcgctgacttaccatcaacgttacacaatgcgctgaaagagttccagacagatccgacgatgaagaaggcgttagggccacatatttatcagagtttcttggaagctaaacggcttgaatgggcttcataccgtcaacaagttagtgaatgggaacgtgatcagtacatggaattgtactaaaccattaattgagataaaaatacgacggttagggcaccttaaatggcgaactagccgtttttgttataaaattggtaaattagtggtgttaacctttattaatgcactaattttcggtaacattaggaacagcaatgcaattcagcaagttttcaattattattgattgcaaggagattattatggaaaaacaaaatcagcctgatcttgaaaaacaagatcaacctacgcgcgcgcttacgaagcgacttcaacaaaagttagactatgtaactacgatgcgccaagcaattacggctggtgacgaccggttgatctacgaattgatcgatggtgaccactatcaccaagccttacttaacgaggaaccggatccaacccgtaacgcccaagtggatttaattacggatgtctatccggcaatcagtcactacttgagtaccaagttaattgattatttggctcatgagtacccattcttttattatgaagaaacccaactcggcgaatttcagatttactttggtaactggtgggatcggcgccggtttggtaaattgaacgttttgaaagtcgcctttgaatttagttcggaagaatacaataaattacaaaagacgtttgaactggctcccgcgcacaaacgtttcaatacagatcgtattcagcagatctcagctggtagcgatcagctacagaaactgattgacgcgcaatcagaccgtgatgcgcaaaaagaagaattgcggcagcaactaaaggaaaatgggcaacgtaactcactatttgattctggtcggatcaaagaagaacggcagcaaattattgaccagttaactaagttggccgatgaagacgaacaagctaataatgcccatgcaaccatgaaggataacgaagctaagattttaacgctttctaaggaagatacgattttagcttatgagaaacaagcgattgaaaacgcctttaagagttttgagaattttaatgagcgtaaccgtagtctttatgttgactacttgaccacgctgattgggaaggcgcaggtagcggctgatggcgaataatacggacaagcagatggacacggcaacactgagcactcacggtaagctgagtacgttcaatgagggcttaaaaaaaggactcgctaatggtgaaaaatttacggccttgatggaccaactgattgatacaactgacggggagacactgttagcagcggcacaacagctagcagactttaaactggatacggcttacgtgacgtttccccatcaatatcagaatgccgattattatttgatcttcatgagtcggttattgggcatgcatggtgatgaacaagcggtgctgaattctcaacggcatactgaagcgctgtatcacgtttacggggcgctaacggatgattacaccttcttgtatcaagtggtgaacaacggcaacggtggtgcatattatcgtgaacaaacaactggcgaaaacttgttttatattcatttagaacggcgcttgttacggtttaatagttcggcgtttacgaatttatttattaataaattattgttgaaggggactggggttgaccaaattaatacggttctcgcaacgctaattaaatttggacattgcttacaagatgattttggctttaacgtcgactttaatattttggacgttgctaacgcggctaaatatgaacttcggtcggctaatttagatcgggcaatcgttgacaaattgtttgtcagtgcggctaagaatgagcacatgttgcgtaattcacagcaaggacatggtgcccaaattgaactgcgggctggtttgacagttgatatctttgatgcagctgaagctggcggtagtcaacaatgggtcctgactgttcatgatcctgatcaagcagtttcgtggtttgacgtgttgttacactttgggttcatgcgtgattggtacttagaaaatatcgattcgctagaaataaaagcggatccattagtatttgcttaagtaacgggggtattagatgttagaactaacaacgttattacaacagtcgattcgtttagaccgcgatattacggcccgtcaacagattcattggcggccacaagaacggttgcaaaatgcgatggtctcactggacgtcgaattggcagaaatggctaatacgtcggaatggttcaaagtttggaagattcatcgtggcaaagcggatcctgataagacacaccgcgcaacgctgctgaacgaatacgtagatgcgatggacttcttcttccttgtctcagcgattcaacagtggacgcatttgattccagtaacgcctgagcaattgactacgattgcggctaagccggcgactgatttgaataaacagtacttggcgatcaagcacctcctctatgatgcttactttaaccatcgtcaggagagctaccagcacgcttggcacgttttcttgaagattgggctagttgattttggttttactcaggacgagatacagacggcgtttacggccaaaaatcatgtcaatgagcaacgacaagcaaataactattaaaaaaataacctaattgcgcgatttgatcacgtaactaggttattttttaagcctctgtcattaattgcgcgtcgttatcggcgtcttgtgcaactaagtcattaacttggtcgatcaatgtttgtcgttgatcaagatcatcgtcgcattcaaagaaggccccgagttcctcagctaaagtatctttgcccgcatccatataccgaaagtcattgctggtgatcgtatagtgctggtgatctggcatccggacgatgacacaaccagtggctgactttcccttggtggctttgtccgtaaactcgaccgcgagtacgtagggcccgtcagttgaacgatctttgatggcatgcgcgatatttccggcaattgcttcaagtttcaatatgtttcacctcaaaacatattatacgcactattaggatgggatgcgagaattgatttagtccatcagctgctcggccagccgcttctgttcagcgtagaaagcgttaaaggcgtggtgggcgttgatgactaggtggtaatggtgctgtgcgactaataagttatgatgaaattcaaaggtgtcacgcccttgctgaataaacgttaagtaatcgttcagataaatgttactggttaagccatggcgtaaaagcattgttgattcccccagacagtattagatacgttgattgtactacaccaaggttgtggtggattggacggtgtcttgattgtaaattggtattataaacgacgactgttacaattttgatattttcagtttgtcttccaccaaattaattggatagaatgcaatttttaggtaatagggtgatattgtccaatgcggcaaatgctctttcactcatacaagctgtgaacctaatacttttgtttttttatgtggatgctcagtttaggtagttgttgacctttttaatatctatgccgtcaattggctgatttaataagcacgaatacgatttggctgccgaaatttattagaaaccaaaaatagagaagtttgctaaacgttggtttaacaagcttctctattttaaaatggcaggtccgaatcgatggtatgtcacgagtgagacttgaactcacaaccctccgcttagaaggcggatgctctatccagttgagctaccgtgacaacaacaagactaattatagttaagaagctggagagtgtcaatttttatttaatttttcaccgatgtgcagcagttaaaaaaaggcgtgagtaagcagaatgatgtaaaaatgtaatatttgtaatgaaaaagcactaaattacagtaagcacattttgctgagataattggtcattatggtgaaagtcaaaaatgaagttagcctggtgaacgaggaaattgttttcatgaataccaattaatgcttgaagaacgacacaatataaacgctgtaatagcggtaactaagtccggtcatcattaatttaatttttgcaagacggggttgttaaatggcgacggcgaagaaccaatatctcctaaaatacttaagaaaagataaagaaattaacaaaactgactaaaatagtttgtttcgcttgaaatgttactgtaacaaaacgataataatcatgtaacaaggaaggagaattcttatgggttcagtatttgcaatcgtcgggatcatcgccatcgctggtggcattcaatattattcaaactttgttgccaaagaaaatgcaagcagtaagcatttcactgcttcccgtaatgaccgttagtcaacgggagttcttatcttgcacattggcattatacaatcaagtaattaaaaaagaactgctcatnnnnnnnnnnatgagcagttcttttttaattacttgatttttggtgttttttcgatggtgtcagtcttgccggcagcccaacgttggatagcagcaacttctttttcgcgacgaatgcgcttttgcttcccagcaactggccgacgtgatgcccatgtgttatatggttttgcaacaacagtcataagagtatgtccctcctttgattagtccaataacgactatattaaacaagaatagtgtacattgcaaccgaattaacaggaaaagccagacttttcccaaaaattgcattattagtataacggttatttcggtcggttgtcaagataaaatcctttacagcgtttctaaagatcaatttagctttgaattgatgctaaggcatgtaaggactaaccagctagtatgatagtggcaggtaggtgagccccatatcaatcatgtgtcagtcgaatgaatgggccagatagatcactgagaaccatcttagacgtaatctaactatttgtccggctgattatcatctgttagacgctcttagtaattaatgttatattaattatgaaatgaaagtagggagcagatatgagtcatgaagttgatccgcgtgtcgataaaactcggcggcgcttgcgacaagcattaattacactattacagacagaaacagtcgataacatttccgtgcaaaaactgactagtacggcagcagttacccgcggaacattttatctccactataaagacaagccagcatttgttgatcaggccctagatgacttggtaagtgaattgtttgaaacggccatcgtgacggtttcagtgggtgatattatgaccaatccggctgacccgttacagcgggtgcatgttttttccttatcaaaggcactcggttacatcagtcagcacgcggaagcctttgagacgctattgttagatcagcgccagttagcggtcaatcaacggatcaatcagcagatgacgacgtggatgacgaaatttcaccgtgattttcaggatcaatttgctgatttggaagtaccggtcagcattcaaatcgcgtattacgtttctgcgacagtcggcctgattactgattggttagctaatgatatgatctacacgccacattacttaaccaagtgtattaaaaaaatgcaccatttgatgacggtagggagcattagtttcacggacttttttgtgaagtgaaatcaatccttgactattatgaaaaaatttgataatattttcctgttgtatttgtggacttctacagctacaaccgcacggattgagtcttaagttcagcaatggcacttacattcggcgagtctaagtgatttataatttaaggaggtgcacaaacgtgtacgcaattattgtaactggtggtaaacaatataaagttgaagcaggccaagcaatttacgttgaaaaacttgacgctgctgctggcgacaaggttacttttgatcaagtagtctttgttggtggtgacacaactaaggttggaacgccgactgttgatggtgcgacggttgaaggtactgttgaaaagcaaggccgtgaccgtaaagtggttactttcaagtacaaggccaagaagggccaacatactaagaagggtcatcgccaaccatacactaaggtaacgatcgacacaattaatgcataattaagaaagtaggcattctttatgattcaggcaaccatttctcgtaatgcgaccggtcaagtgaccgcttttaagttgacgggacatgctgattcaggtgcttatggacaagacatcgtttgtgcagcggtttcggtgttagcaattagtacaatcaatgggattgaacaagttgcccgcttgcaacccgtagtacaaagtgatgaaaccaatggtgggctattaattgcagatttcactaagctggacttggcgaacacacaattacaaaccttacttgaaagtttcacacttggtttgaacgatgtggccacgaattacggagattacatccgagttcgtgaacaaacacgataaccacattcggaggtggactttactatgttaatgaacttgcaattcttctctcaccataaaggtggcggttcaactgccaacggtcgggattcagctggtcggcgtttaggcgctaagcgggctgacggccaaactgttaagaatggtaacattctttatcgtcaacgcggaacccatatttacccaggtgtaaacgttggccgtggtggcgacgatacattatttgcaatggctgacggtgtcgttcgttttgaacgcaaaggtcgcgacaagcgccaagtatctgtttacccagcaaaataatttttgaagagcctctgcagggaggctctttttttgtgaagcaatctagggatacctgcgactattattggttcacgggccgcttagccgtaaacgtaattgattgacgaatggccttcaataaatcattaccttcagtttttggaaagtttggtataatgaagcgtgaggtaatgatgggagtgacgaaataatgagtcgagttgaacggttacaaaataagtttgatcagttaaaaattgatgcgtttttagtttcagatggagctaatcttcaatatttaacaggaatggctgatatggccggcgatggttatctgctagtactggcacaggaagcctatctgattacggatgcccgttatcagacagcttttgccggtcactatgatgaccagcacctagtcattacacgtgattatctgggggccgtttgtgatattattgccaaaaccggtactggggtcatgggcttcgaggccgagattccatatacagcctacagttacttagatgagaacttggtcagtgatttggttgcgttaccggacgtggtcgatgagttgcgcatcaccaagagtgttgatgagattgaccggctacgagcgagtgcacgtttggcggatgctggtttcgaatacgtaacgagtatcgtgcgaccaggcatgcgtgaaatcgacgttagcaacctgttagacgcgtttatgcggacgcacggtgcaagtgggccgtcgttcacgacaatcgtacttggtggtgcacgagcggctttgccacatgggacggcttctaaagcactcttgacggccgggcaacttgttactcttgattttggttactttttggacgggtacacgtcagatatgacacggacgtttgctttaggtactccggatgataagttggttacggcctaccaggcggtgcaggccgctcaacaggctgtgatcgatcaggtccaagcaggagcagccactgctcaactggatgcagttggccgcgatttgctgacaaaagcgggctatggtgacgccttcaatcatggtatgggtcacggcattggtcttgccattcatgaaggcccgttgatctcaaaaaacacgactggcaccttagttgcaaacagtgtgattactgttgaacccggggtatatttcccagatttaggcggaatgcggatcgaagatgatgtcttagtgactgctgagggccatgaacgactgacgactgcaactcgtgatttactgattttatagttaagacagttgccacagcggctcggtcttgttatagttataaagatatatttgaggaggatttttaaaaatgatttcaactgcagattttaaaaatggtttgacgattgaagtagacaatgcaatttggcgcatcgtggaattccagcacgttaagcctggtaagggtggcgcgtttgttcgttcaaagcttaagaacttacggacaggagccgttcaagacaagactttccgtgccggtgcgcggatggaacaagcgccaattgaaaagagtacgatgcaatacctttatgccgatggtgacagctatgtcttcatgaatacggaaacttatgaacaaattgaaattcctggcgaccacattcaagacgaattgaagttcttgaaggaaaacatggaagttcaagtaacgctttataagggtgaagtgttgggaatcgatttgccaaacacggttactttggaagttgctgaaactgaaccagggattaagggtgataccgcttccggtggctccaagccagctacgttggaaactggtgcaattattcaggtaccattcttcgttaaggccggtgacaagctgatcgttaacaccgttgactccacgtacgtttcacgggcttaatttttagaaaaactaataccggcaaacatggaattggaggaatgtcaaaatggctgacagtagcaatattacgttacaaagcaaagaacccagcttaggacaaattcaaattgcaccagaagtgcttgaaataatcgttggtatcgcggtaagtcaaattgatggcgttaaccggatgcaagggacgatttcttccagtgtaaatgagttgttcggtcgcaagaagaatcttggtaagggtgtcaagttaacaatcgtcgatgatcagattagtgttgatgtgttcgcatacttggactatggtgtttcggtaccaaaagtcgctttagcgattcaagataaggtcaagcaacaaatcttatttatgaccgacctcgccttaagtgaagtcaatgtccacatcactggtatcgtgactgagaagactgaaagtgccattgatccaaacaacttgtttggtgatgaagatacccagaccgatgaaaatgaagatggtgaagaatcgtgagtttaacgcgtcatgaaatccgggaaaaagcatttcaagctttattcgcgttgaatgctaacccagacgctgatgaaaatcagttgttccaacagttactcaaccctgaagaagcggatgcagttgaaattcccgcatatttaagtacgttagtaactggtgttcgtgaacatcaagttgaattagacgctcaaattcagccttatttaagtcagaagtggtcgttggaccgactggctaagaccgatttgattatcttacgcatcgcgttctttgaattgcaatttgttgacgacgttccaactaaggtcgcggttaatgaagcaattgaattgacaaaggcgttcagtgatgaccgctctcggaaattcgttagcggggtgcttggtaaagtggttaaaaaccaagccaattagtctaaaaccgaacaatcttatgttctaccgtaaaagtctggcgatttgccagactttttttaataacttattagtaaaccggtcataaatcattgtggtgaatatgctaaaataagaccagacagagaaagaggagtgtggcacttgtgacgaagattattgatggtaaggcagtagctaagaaagttaacgcgcagacggcaacggcagtagcggaattggctgctcagggaattcaaccagggattgctgtaattattgttggggacgatgcagccagtcaaatctatgttcgaaataagaatcgtaaagccactaagttggggatgcactccgtggtgcggcagttgccagcgactactagtcaggacgaactgttagccattattgcggcatacaatgcggatgacagcattcatggcatcttggtgcagtcgccactaccagcccaaattaatgaaccattgatcacgatggccattgatcctaaaaaggacgtcgatggttttcacccgacgaacgttggtaagttgatcaccaattttccaggtaattatcctgtagcaaatacgcctcgcggtattatgacgatgttggctgactatggggttgatccggctggtaaaatggcggttgttattggtcggagtaccattgttggtaagccgatggccgctttgttaacaaatgctaacgcaactgtaacgattgcacatagtaaaacagctgacctaaaggcggtcgcccggacggcggatatcttggtggttgcaacggggattgcacacctgatcactggtgctgatatcaaaccaggcgcgacggtcattgatgttggcatggatcgtgatgaaaatggtaaactagtgggtgacgtcgattttgattctgctcaaggcatcgcagggttgattacgcccgttcctggtggtgtgggtccaatgacgattgccaccttgatgcagacaacggtggaacttgcaaagtggagtgatgtaagtgagtgaaagtcaacaatatttgacagtgacagctttaactcagtatttaaaacgtaaattcgaggttgatccgtatttaggtaaagtgtacctaacgggggaagtttctaattatcgtccccggcctaatacgcatcaatatttcagtttgaaagatgaccatgccaagatttcagccattatgttcaagtcggcgtttgccaaggtcaaatttcagcctgaagaaggtatgaaggttctggtcgtgggccggattggtctgtatgagcccagtggtagttaccagatttatgtggaacgcatggaaccagacggcgtgggtgcgttgtatcaagcctacgaacaacttaaaaagaaattagcggctgagggcttgtttagtgcacccaaaaagccgcttccgcgctttccaaagcgaattgcagtggtcactagtcgtagtggcgcagtgattcgcgatattatcacgactactcggcgccgttttccgattgcgcagatcgttttgtttccatctcaagttcaaggtgatgcggctgcggccgaaattagtcggcagatcgaacgtgccaatgcgcaaggtgattttgatacattaattattgggcgtggtggtggttcaatcgaagatctgtggccattcaacgaagaagtggttgcgcgtgcaatcgcacagagtcaactgccagttatttcatccgtggggcatgaaacggatacgacaattgctgacttggtcgcagatgtgcgggcggccaccccaactgcggctgccgaattagcggtaccagtatataacgatgttttattacaattaaagcaagaccagacccgcgtgttcaatgcatttcagaatttcgttcaacgcgctcgacaacgacttaataaattacaaacgtcgtacgtgtttactcagccgaaccgcttgtacgaagggtatttgcagaagttagacttcttaaatgagcgacttaaacaggctggtcaaaataactttaatctggcaagccagcactaccagcgtgtttttcaacaattacgacagcaaacgccgattcaccaagttcgccaggcacaaacgcaactgcttaacttgcagcaacggctgaatcggggtacccagttagtcgtgcggcaaaaacggcaacaactgacgcagaccgtccaatcgttggatctacttagtccgcttaaaatcatgacgcgtggttacgcctttgtgacggcggatgaacaggtggttcacggggtcaaacaattgcagccagaacaaacggttgcaattcacatggctgatggtgaggctcaggcacagattacgaagattgatggaggaaaataatggctgaacaaccaacttttgaacagaatttatcacaattagagacgatcgttaatcaattagaacaaggcgatgtccctttagaacaagccttggatcaatttcaaaagggcgtggcacttagcaagcagttgcaagcaacccttgaaggtgctgaaaagacgctcactaagatgatgaatgaaaatggcgacgaagttccatttgagcaagctgacgccaatgaataagcaattattaactgaatttgaatccaagtggcgtcctcagattaatcagtatttagatgagcagcttcaagcgtgttctgaccaatcaaccctgactgacgccatgcgttattcggtactagcaggtggcaaacggttacggccgttattgacgttagccattttagatacttttgatatcacaacgacggctgcaaacttgcgggcaagtgtggccgttgagttgatgcatacttattcgctaattcacgatgatttaccggcgatggataatgatcagctacgacgtggcgaaccgactaaccatgttaagtttggggaagacgttgccattcttgcaggggatgctttacaaccgttgactttcgaatggattgcggatagtgggttaccggcatcgatcgtcgctaatcaaaccttagcattagcgcaggccaccggacctcgcgggatggtggctggtcaagttgctgatgtccttggagcgggacaacatctggctttgccagccttacaacagctgcatcgcgagaagacgggggcgttaattcactacgctgtccaggcagggttgattcaagctcaagtgcaaccaaccgtgcaggaattgctattacaatatgctgatgcctatggattggcgtttcaaatttacgatgatattttagacgtgacgagtacgcctgctcagttaggaaaagctacgcataaggatgccgatgagcataagaatacgtatccaggtttgctggggcttgcaggcgcacgaacagcgttagaacaagcggtaacagctgctcaaacggcgttagtaaaagctagtactgctagtcaacgaggcatgggcttgcttgcagcttttctaacgtattttacagattaaggacttaaatttagatggaaaaagaacgagttgacgtattattagtacaacaaggattatttgatacccgcgaaaaggctaagcgtgccgtaatggccggtgaaatcttaggtgtcaacgaagaacgcttagataagccgggcatgaagatcccagtggcaactgaattacatttgaaaggcaaaccgatgccctacgtttcacgtggcggtctcaaacttgaaaaagcactcaaaagttttgaaattgacgtgaccgacaaaacggtcctagatattggctcgtcgactggtggttttaccgacgtggttttacaaaatggggcaaaaatgagttacgccttggatgtcggtagtaatcagttggtctggaagttacgccaagatccgcgcgtggttgtgatggaacatactaactttcggtatagtaaactggcagatttcacgcaggggcaacctaacttcgcgtccatcgacgtttcatttatttcactacacttaattttgcccccattacacgcgattattgaaaacggtggttcagtcgttgctctaatcaagccacaatttgaggctggccgtgagaatgtcggcaaacacggaattgtccgtgatcctgctgttcatcaggcggtgttgacagatatcgtggaatttgcgcaagcgaatggttataacgttctagggcttgattattcaccaatcaagggtggtgaaggtaatattgagtttctaattcatttacaagctaccgatgaaacaccacggattgcgccgactgtgtcgattgaaaaaactcaggcggccgcttatgaacaattaaatcaagcttaaaattgaaatccggactttcatatttatgcattttggcttatgatgtgtttaaataagtatgaatagctaccgggggtgatcgggtgaagaagcaagagcgccaacgctacattaaacgattattgagttcgaacgaaattgaacgtcaagaagactttgtcaagctgttacgtgctgaagatattgacgtgacacaggcaaccatttcgcgcgatattaaagatatgcagctggtcaaggttccctcggtaacgggcggttaccactatagtatgccagttcagaaacaaatggatacggagaaaaagctcaagcggacactgaaagatgcttatgtctcgtatgcgactcaggataaatttgtcctcatcaaggtgttgccgggtaacggaccagcactagcaacgttgattgaagcaatgcattatgacgaaatttttggaacgctaggcgatgatgctcatgttctgattatttgcaagtcgttagcgatgactttagagctacaacaaaaaattcaacgcttactgagtgatcactaattagtaagctatcttcgacctgctcacatgtgtgtcaggtcgctttttttcaaaattaactaacggatgctggtaaccaattgcttttaaggagggcttgcagtgttacaagaattatcaattacgaactttgcaattatcgaacacttagacattgcttttgaagccggcatgacggttttaactggtgagaccggtgctggtaagtcaattattattgatgcagtcggtttattagcgggtggccgcggctcggcagagtttattcggaccggtgctgataaagccgttttgcaaggcatgtttattttgccggctgacggcgtgacggcccaattgttggacgaagcggggatcgaacatgcggataataccgtcattctacagcgcgagattactaaaagtggccgtaatacatgtcgcatcaatggtatgctggtcaatacgacgactttgaaacagattggtgaaacaattgttgatattcatggtcagaatgaacatcaagagttgatgcaacctgaaaaacacctgggattgctggacgagtttgccaccgctaaaattcgtaaattgaagcagcgttaccagcaacagtatgatcgttatcagcagttaaaccgtgaactgcggcaaaagaatgcgaatgaaaaagagtgggctcaacgcttagatatgctgaactttcaagtggacgaaatcgcagcagcacaagtcaaagtgggtgaagaggccagtttgactgcggaacgtgaccgcttggataattaccaaatgatcaatcaagcgcttcaacagagttacacattgttagctgcaggtgaggagacgactggtgcggttgatatggtcggtacggcgatgaatgcactagaaccgattgctaatttggaccccgcctttaatgagattaccgtgaatgtcaagaatgccttttatgggctgcaggacgcggccggtcagatttctaatcagctcgatttgcaagaattcgacgagggtcgcttggatgaaatcgaacagcggctggacgttttggcccagttaaaacgtaagtatggggactctgaacaacaaatcttagattattaccaaaaaatcgcggctgagttagccaagatgactgactctgaagaaaatagtgaagatctggcccagcgggtcgccgatctgaaacaacaactacttacgacaggcgaagcgttgtccgataaacggcgggctgcggcgaaagtgttacaacgacagatccatcaagaactcaaagatttgtatatggataaggcaatctttgaagtacgattcaaaccgactaagggtcagatctatcggagtggtctggacagtgttgaattttatattcagactaatcctggtgagcgcatgcgcccattggctaaaattgcgtctggtggggaactctcacggatgatgctggctttgaaaaccattttttctgaatcacagggaattaccagtatcatttttgacgaagttgatacgggcgttagcggtcgggttgctcaagcgattgctgagaaaatcaacggcattgcacacttttcacaagtgctctgtattacccatttgccacaggttgcggcgatgagtgatcaccactacttcattgccaagaagattactggtaaacgcacgaaaacgagtgtgactaagctggataatgcggcccgggttcaagaactggcacgcatgttggcgggaactaaagtcactaagttatcgcttgagcatgcggaagagttattgcgactggccgatgaggaaaaagacgattaggcttaattgatcggtaccacaagggacggacaactatggtcggtctttttttgatggtgttaattagtgacgatagtgtcgagtgaggtttcggtattattgccaaggcgacgataattctttacaatataaaacgcaaatagacgaaatatgggtcaacggacacgttttaatgaactgtcgggctggttggtagtgggtggctaatctgaagctccgactaccaaaatataccgttaaaacgataaaatgttcagtttacatgtcatgacgtttgcattttgctttcgttataagttatgcttaattacagtacagtttattcggcaacgaaataaactgagtaaatgattggagtgatgaggttgtttctgacaatggaacatttgaataaaacgtatcctggtggcaaagtagccgttgaagattttaatttggaaatcgaaaaaggtgaatttgtttgtttcatcgggacgtctggttcaggtaaaacgaccacgatgcggatgattaatcggatgttaagtcagacttccggtaccattaaacttaatggtaaggatattagccagattgacccggttaaattacggcgacaaatcggttatgtgattcaaaatattgggctaatgccccatatgacgattcgagacaatatcactttggtaccacgattgctaaagtggccccaagataaaatgaatgaacgtgctaagaagatgatcaaactggtggaattgccagaagattacttggatcggtacccgtcggagctttccggtgggcaacaacaacggatcggggttgttcgggcgttagcagcagaccaagatttagtattgatggatgaaccatttggggcgttagacccgattacccgtgaatctttgcaagatctcgttaaggatttgcaggaacgcttaggtaagacgttcgtctttgtaacccatgatatggatgaggcgttaaaattagcgacccgaatcgtaatcatggatggtggcgacattatgcaagtggatacgccagacggtatcttacgtcatccagctaatgaattcgttgagaacttaattggtaaggatcgtttgattcaagcacggccaagtattaccactgttgggcaagtgatgttgaaagacccaattgccaccacaccaggaaagtcattgacggtcgcattacgacaaatgcatgataaacgcgttgactcgttgttagtcaccgatgaagccggcatcttgaagggtgtgatcggcattgaagacgttgattacaactttaactcggctactagtgtgggcgacattatgaagactgatttgttctatgttcagtcaaattcattgattcgggatacggtcgaacgtattttgaaacgcggcttgaagaacattccagtcgtagatgaacaacatcgcctggtcggaattgtaacgcgggccaccctggtcgatattgtttatgatgctctctggggtgatgaagacgaagatgaagctgaaaataatattcatcatggggaggacgatgcgcccgctgaaggcggtgaacaggcatgataactttcctacaaaactacggcatgcagctgctggttaagacgtggcaacacttgtatatttcagcgttttcattgttcttaggcattatcgtagcggttccgattggaattctgcttacgcgggtgaagccgattgcgaatgtggtcatgtcaatcgctagtatgttacaaacgatcccagcgatggcgttgttggcattgatgatcccgtttttcgggattggtgcaattccagctatcattgcgctgttcatctattctttattaccgattctccgcaatacctatcttggactggaagacgttgatccggccttgatcgatgcggctaagggaatgggaatgaccggttggcagtcaattgttaaagttgagttaccgatggcagccccagttattatggctggtattcgattatccgcaacgtacgttattgcctgggccgcgttagcatcatacattggtgccggtggccttggggactttatctttaatgggttaaacctctatcgaactgacttgattttaggcggttcgattccagtgattatcttagccctcatcgttgattggctgttgggtaaactagaagcagcggttaccccaagaaccacacaagcgtaagggggattaaagatgaagaaaattaaaaagtggttgttaggtgttttcgcaacggtcgccagtgcgttattattggccggctgtggctttccgggtttgtcaggaacttcatccgatacgatccggattgcgtcacaaaacacgactgaacaacagatcatggcgtacatgattcaagatatgattaagcattattctaatttgaatacgacgatcattaacaatttaggttctgggacggttagtttcaatgctttgaagaatgatcaggctgatatttcagcgattcgttacactgggacggacttaacgacgattctgggtgaaaagatggatcggagtaatatcaagtcgattgaccaaaaagttcgctcacagttcaacagcaagtatcaaatgacctatttcccaagttatgggttcgcagatacctatgcttttatggtgacgaaagcgacggccaaaaaataccatctaaatacggttagtgatatgaaaaaagtagcctcgaagctgacggtcggtttggatcaaatctggactgaacgaaaaggtgacggctatcctgcctttaagaagttgtatggctttcaatttgggaagacttatccaatgcaaattggtttagtttatgatgccttggaatcaggtaaaatggatgccatcctcggatactcgactgatggtcggattggtagttatgatctgaagattttaaaggatgataagaatttcttcccaccatacaatgcgagtgcggttgcaacgaacaagatcttgaaagctcatccgaagttgaagccaatcttgaatcgattaaacggtaaaatcagcttaaagacgatgcaaaacttgaactatcaagttgataataacttagtggaaccggaagttgtggctaaacagttccttgaaaaacataattactttgaagggagtgacaaataatggctcagatgaacttactgcaacagttgatatattattaccaacaaaacggtgtgtacgtgttaagccagttctcacgtcacttcttgatttcaatttatggcgtgctgtttgcggcaattgttgggattccaattggcattttcattgcccatcatagtcggttgagtgcgacagtgatcgcgattgccaatgtgattcaaacgattccgtcactagcgatgttatcaatcatcatgattggtttgggcttaggtgtgaacacggtaatcgtcacggtctttttatacgcattgctaccgattatcaagaatacctatactggaatgcaaaatgtgagtgctagtattttggattccggtaaggggatggggatgacacgttggcaattgttacgaatggtggagttgccactgtcactttccgtcattatggctggacttcggaacgcattagtgttggctatcgggattacggccattgggactttcgttggtgccggcggtttaggggatatcattattcgaggaaccaatgctacgaatggtggtgccattatcttggccggggcgttaccaacagccttaatggcaatcattgctgatacggtcttggcttggattgaaaagcgtgctgatccaactcaaaaataacgtcagtgagcgacaagtaaaagaagcaatataaaaattaagttactaaaaaagattgatttacaggtactccgtactcactcattcagggaagtcagtggagctgtaacatcaatctttttgatttgcatcaaaaacaccatgagaatacgcaaggttgtattgaacatgatttcatcttttgatgcaagtattaatgattaaactaaacgcgtttgatataacggatggcgtccgggtcgaccaagtgggtcaggtgtaactgccgattaactagaaccaactgaccactagcgagggtttttaacactccgtgaatattatatggtcgggactcagtgagctgaggctgcatctggagcatgatttgatagtgttccgtgtgcgcttgagctaagaacaaatcccgctggaaagccggcatcattggcagtaacggcgcaacgacggtcggggcagcagtaaagtcatccataaattggcgataggaagcgtgtaagttcttggaaattagtttcaaattagattgttgattttgcatattagccacctcgaacatttgtttgtgtttccattatacgaacaggcgttctaaaaagcaagcctaaaatttgagaaaattcacgaataaaaatgaaaaaaagctgtgtaaccttgataatacttgcaatatagggttaaaaagtgcaaaataaactttaaaacatattttaattaaggggaatttgtgatcatggcgaaacaaggcatgttaatcgtcttatcaggtccttcgggtgtcggtaaaggtaccgtccgcaaggaaatctttgactcagatgataacgattttcaatattcagtctcgatgacgacgcggcaaatgcgtccgggcgaagtagatggcaaggactactattttgtgtccaaagaagagttcgaggatgaaattaagagcggcggtatgcttgaatatgccaagtatgttgacaattactatgggacgcccttaaaatatattaagcagtcgttggcggctggcaaagacgttttcttagaaattgaagttaacggggccatgcaagtccgcgaaaaaatgcctgatggcgtcttcattttcttgacgccgccggatttgatggaattgaagcaccgcatcattggtcgtgggactgatgatatgagtgtgatcaacaagcggatggcaaaagcggttgatgaaatcaagatgatgcgtaattatgattatgcggttatcaatgatgaagtcccgctagctgctgaacgaatcaaggctattattcgtagtgaacggtttagtgttaaacgggtcatgcccgagtatgaagaaatgttaggagatgcggaatcatgatcttatatccatcagttgatgacttattgaagcaagttaattcgcgttactcattgattatgttagctagcaagcgggcccatgaattggacgctggtgcagcaccaatgcttagcgaatacaaatcggttaaaacgattggtcgggccatggaagaaattgcggccggtgacttaatgatcgatccagatgaaactgacaaagattagtaacaaaacggtgtgctgagccagctggggcttggcactttttttatgaagaatgacgcggacgttcagcttcacgttactgtcgattcttgatacaattgttttattaaagtgtaaaaatctcgctggcacggttgcgagatttttcaaaggacgtgaagaagtgagtatatggacaaaacgccatgtaacggtagtcgttagtggtgggattgcgagttataaagcgttagtattgattcgtagtttgatgaaacagggcgccgtcgtgcgagttgcgatgacaacccatgcggcaaagtttatcacgccattgacctttcaaactttaacgcagcagccagtggtcattgatgaattcacaacgactgacccgcatcacgtcgtccacgtcgcgttagctgactggactgaagtgatgattctcgttccggctaccgccaacttgattgctaaggtggctaatggtctagccgatgatgccgcaacgacgacaattttagcgacgaccgcacccaagtttgtggtgccagcaatgaattcacatatgtacgctaatccagcaactcagcgcaatttgaagcaactgacgacggatgggttacacgtcttaactcctgctacgggtatgttggcggaaggctacagtggtcaaggacgcttgccggaaccagcggtgattttggcctggttgacagatcaactgattcagttgacacctgatttgccattagcaggacggcgagttgtcgtcactgccggcggaacccgagaagccttagatccggtacgatttatcacgaatcgttcatcggggaagatgggctacgcagttgctcaagtcgcacgggagttaggtgcaactgtgacactgatcagcgccacgactcatttagcagcgcctagtggtgttaaggtcgtgacggttgattcggctcaatccttattgacggcagtcagtgatatttttgatgatacggatatcttggtcatggcggcggccgtatctgattatcggccggctgaattagctgatcagaagattaaaaagccagctgaccatgctgacttaacgttacgattgacagaaacaccggatattttaaaaacgttagcggcccggaagcaccaacagtatgtgattggttttgcagctgaaacgcaatcattgctggctaatgccaatcgtaagttaactagtaaaaaattagatttaattgttgctaacgatgtttccaaaccgggagttgggttcaatggtgatactaatcaggtcacactgttgcggcctgagcaacaaccagttacgacggaattgacaacgaaaactgcaattgccaaacagatcttgatgacggcaattgcggatggtgcaggaacacaggcatgattaagtagagaggaagagttgtgtggcacaaattgcccaagtattagtcgatgtgcccactatgcagacaaatcgaccttatagttatcgaattccaaccgcctggcaatcacaagtgcaacccggcatgcgcgtcgtggtgccattcggccgtggtaaacggcgggtgcaggggtttgtgttagctcttgatgacgttactaactttgatggtgagctgaaaccaatcgacgcggtcgttgacctagcaccggttctgaatactgaagccttagcactgaccaagtggttggctgccagcacgttttcatttcagattacctgtgcacagaccctgctgccggcggtcatgcgtgcaaagtatgaaaaacagttgcgaacaacagcaacaacgcccgcgacgattcgaacgacgctgtttggggaccaatcgatggtgccgtttgatgacgtcgccacgacgccggcaatcgtcagccagttattacggctgcaggcggctgggcaagtcgatgtgtactaccaagttaaaaatcaagcacggcgtaaaacgcaaacggcggtgaaagcggccttaactaacgaagcgctacaggctgcagtggaccaggtacgcgccggggctacacaacaattggcggtgctccaggggttgctcactttaaatggtgaacagctctcgcaaaaggcgttttgtactcgttttgatgtcacggacggtgccattcgtacagcagtacagaaaggctggcttaaaaaagtggccgtcgaggtttatcgtgatccctacgcaactagtgatattaagactaccaaggcgttacaattgaatgatgaacagcaagtggccgtcgatcagattacgcaagccgttgaccaagccgcaaccaccacgttcttgttagagggtgtgacggggagcggtaagactgaggtgtacttgcaatcgatggcggccgcattggcacaaggaaaaacggcgttgatgttagtgccggagatttcactgacaccccaaatggttcaacgcgtgaagggtcgctttggtaaagctgttgccgttttgcacagtggattgtccagtggtgagaagtatgatgagtggcggcgaatccaacgaggtgaggctcaggtggtggttggcgcacgctcagcggtgtttgccccgctaaaaaatcttggcttaatcgtgatggatgaagaacatgagagcacgtataagcaggatgatgccccgcgttatcatgctcggcaagtggctttatggcgtagtcgttaccataactgtccagtcgtactgggttcggcgaccccatcgttagaaacgcgcgcccgcgcagaaaagggcgtttatcagcgcttactgcttgcggatcgggtcaatcgacggccccttcctaaggtttcaattattgatatgaaaaaggaaatgcaacaacacgctgaaagcaatttctcagcgccactgttagttgccttgcaggatcggcttgaacgtcatgagcagagtgttctaatgctcaatcggcggggctattcatcgtttgtgttgtgccgagattgtggttttgtcttgaagtgtcctaattgtgatatttcactcacgctacacatggatacgcacacgatgaagtgccattactgcggtcacgaagaagccattccgcggaattgtccgaactgtcatagtcgtcagatccgttattatgggacgggaactgaaaaagtcgaagaagaattgcaagacttgcttccggacgctaacattattcggatggacaatgatacgacccgtaaaaagggcgcccatgccaagcttttagcacagtttgggagtggtgaagctgatattttgattggtacccagatgattgcgaagggactggattttcctaacgtgaccttggtcggtgtcttgaatgctgatacggccctaggattgccagattttcgcgccagtgaacggaccttccaactattaacccaggtgagtggtcgagctggacgggcggaaaagagtggtcacgtgtatatccagacatttaatccggatcattatgcgattcggtttgcacaacaccacgattacgaaggctttttcaagtatgagatgcagatgcggcaccggggtggctatccgccgtactactttacggttcaaattacagcgagtgacttagatgaaggggtagcggccaagcgcatgtatcagttattgcaatggttacgcccgcggttggcaccgtcaacgattctattaggtccaacgcccaggccaatcgcacgagtcaatcgccgttattattatcaaatcgtgattaaatataaacaagaacccaatttagctcagacgctgacaacgctactgcatgagacgcaggcgcaacaacgacaagggctacagattggcattgacgtagaacccttacatttcatgtaatgggattaggaggaagtttgacaatgacatcaatcgtttttatgggaacgcctgcgtttgcggcaccgattctcaaaagtttaattaaagaacaataccaggtactaggcgttgtgacccagccagaccgaaaagttggtcgcaaacacgtcttaacagcttcgccagtcaaagaagtcgcggttgcccatgatattcccgtcttccaaccggaaaagattagtggtagtcctgaaatgcaacagattattgacttgcagcccgatttaattgtgacggccgcctttggacagtttttaccaacaaaattgttgaaagctgccaaaattggtgccgttaatgtccatggctcgttgttgcctaagtatcgtggtggtgcgcctgttcaatattcaattatcaacggtgagtctgaaactggaattactatcatttacatggttaaaaagatggatgcgggcgatatgctggcgcagcgtgcgattccaattgaaaaaaacgatgacaccgggacgatgtttgataagttgagcttagttggtcgcgacttgttactggaaacattgcccaagttgattgctggcgaaattacggcggtgccacaggatgaatcccaagtgacctttgcaccgaacattcagccagaacaagaggtcttagacttctttacaaaaacggccgttgaaattgataatcaagttcggggtatgcggccagcaccaatcgcctatgcggtcttggatgggaagcgcacgaagttctgggatgtgaccccgttagctgacgaagtggtcacgcaagctcctggacaagtggttcgcaagacgaaacatgagcttgtgattgcagctgctaaccacacagcgattgcaatcaatctgttgcagccagctggtaaaccgaagatgacaattacagactatttaaatggggcggcagataagttcgctaccggagagcaggttattaataaatgagtacagttggtaataccccccgctggttagcggtcgccgccttagcgaagattaagaacggtgcatattcaaatttgcaattaaaccagttaatcaatgatcatcagatggatcggcgtgacattaatctgctgacaaatatggtttacggtgtcattcaacatcggttgactctcgaatactggttgaccccgtttgttcgacatccgcaccagattgacccctgggtacgggaactcttattgagcgcattgtatcaatggcagtatctggataagattccacaacgggccgttttcaacgaaacgattgaaattgctaaggtcaaaggtcaccctggcattcggcggtttgtaaccggcgtcttacatcaaatggatcgctcaggattaccgagttttgatgcgattaaggatcctgatgaacggttgagtgtgacttatagcatgccaatatggttgattcaagaattgcggcgtcaattaggtgctgaaaagatggagcgaatcttatcatcattgaaccaaccagctaagcaagccttacgtgtcaacccggccctgtcgacggttgaagatgtgacaacggtgctgattaatgatggtttgacaattacgccgagtgaaatctcaccgttagggctgattgcaacggatggtcaggctattaatactgaagcgatgcggtatggcatgtttacagttcaagatgaaagtgcacaattagttgtgccagcactcaatctgcagccgagtgatcgagtcttggatgcttgtgcggcccccgggggcaagacgacccagattgcggctagtttagatgctgagcagggtggcacagtcgttgcccttgatattcatgctaataaagtgaaactgatcggccaaaatgcggcgcgcatgcacgttgctgatcgcgttgaagccaccgaactcgatgctcgtaaagttgagacgcagtttaatgctgaaagttttgatcgaattttagtcgatgctccgtgttcgggactgggattgatgcgccggaagcctgagattcgctatgagaaacagttgcaggatagtttgaacttgcaacgaattcaactggcaattttgacagcagtcgccccaaccttgaaaaaaggtggtatcatgacgtatagtacgtgcacgattttgcaacaggaaaatcaggatgtgattaccaaattcttagcggatcacccagattttgagttgcaaacaacgccaactgaacgagacttgaaaactgatcgaacggaaaagactttgtcgatttatcccgatgattatttatccgacggctttttcattgcttgtttgcgaaaaaaataatggtggagtggtaaacaatggattttgcataccggtcggatattggccaacaacgtgaagaaaatgaggactatgtcggcttttttcaaaataaagcgggcatcaattttgcaattgttgcggacggtattggtggccaccaggggggcgatgtcgcttccgagatggcagtctcgcacatgggttttcggtttgaaaatacaacattcaaggaacccaatgatgccgtcaagtggctagcaagtgaagttcaagatgaaaatcagcatattattgaaaaggcccgtgaattttcagatctaaacggcatgggtacgacaatggtcgccgctttgctttttgatcaaaagtttttgatggctaacattggtgatagtcggggctatctttttcgcgatgggcaactccaccaactgacggaggatcattctttagtcaatgagttggtcaagcgaggagagatttcagccgaacaggcccgacaacatccgcagaaaaatattattacgcggacactaggcatctcaccagatgcggatatcgatacgaacctttaccagatacaacctggggaccaattgttattatgttcagatgggctgacgaatatggtgactgaccaacagcttgcgacggttttggcaacgacgcagacttcgacccagaagtgtgagacgttgatcaaattagccaatgcagctggtggtaaggacaacattacggcgctgctgatggcgcttgatggtgaggtggccagtaaatgacacccaactatacccttagcggacgatatcggatcgttcggtccttaggtgaaggtgggatggccaacgtttacttggcacatgacttaatattagatcgtgatgttgcggtcaaactgctccggttagacttacgtgatgatcctaagaccatcaagcgattccaacgtgaggcactggcaacgacggaacttgttcacccccacattgtcagtttgtacgatattggcgaagaaaatggcatgcaatacttggtcatggaatacgtcaaagggatggatcttaaaaattatattaaagagaactttccgttaccgttacagcaagtaatcgacatcatggagcagatattaagtgccgtggcaacggcccacgcgcataatattattcatcgggatttaaaaccacaaaatattttaattgatgagcagggcaatgctaaaatcactgatttcggtattgcggttgcgttatctgaacataccatgacgcagactaacacgattttaggttcggtccattatttgtcaccggaacaggcccgcggtagcatggcgacaaaacaatcggatatctattcgttagggattattttatatgagatgttaacaggctcagttcctttcaagggtgagacggcagtttccattgcgttaaagcattttcaaaatgcaatgccatccgtgcgagagtttgatgcggatattccgcaggcacttgaaaacgtcgtcttgcaggcgacaacgaaagatccacgggaacgttatgctacggtcgaggacatggccactgacttattgacggtgcttgctagtagccgtgcgggcgaaaagcgctttgtaccgcaagatgtcggtaatgatgagactaagatcatgcccagtgcggatattcaagcagcaattgcggccaatcaagacggtaagacccaggtcgtggcgcataaaagcaagcaaccaacactccagcgcccggctgaaacgactgagagtcagacagatgctgatgaagaaccgttaccaacacgttcttggtccaaacgacatccgttgcggcgtcggctcctcttttggggcggtattattttgttattagtcgtggccgtgatcgtcggtttggaattaagtcggccacagatgacgacggtgccgaaagtaacgggcttaagtcagcgtgccgcaactaaggtcctcaaaaaacaccatctcacggtcggaactgttcaacatgctaaaagtaatcaggtagccaaaaatcaggtgatcaaatcaacgcccagtgttaagacgcgggtccaagaacgtgctcgcattaatttggttatcagcaacggtgccaaggttatgagctttggtaattatgtcaatgataattaccatgatgttcgacagacgcttaaatcggcggggttcaaagttaaggaaacttacagtacgtcgtcggttgcagcaggacaaatcatcagtcaggatgttgtcgctggtagtcgcgtgatgccgacagatacgacggtgacgtttacggtcagcgctggtagccgctacgtcgagctaaaagatttaactggtgagagcaagagcgatattctggactatgctgaggcaaatgatcttaatgttaactttaagcagggctactcttcggaacagaaggcaggttattcctatgatcaagatccagatggcggtggcaatgtccggactgggtcgactattacggtgaccatgtcaaggggcagtgataataacgtgacgacaccacagaatttttatgttaaactaacggtgccatacaaagcgttatcggccaccactgcccaggccaacgatgttaagatttatttgtatgatgatacccatatgattgagaccgtttatcgcgatattgcaatcatgcggtcgactaagattagtttaccgtttcagctgaccggtaatacgaaggggcattaccgaatcgtgcgtaacggggttacgatcatggaaaagaagaatattacaagcaaaaatgcaacaaaataaagataagtcatgcgcaatgcatgacttttttggtacaatagagaaaagtggaccgtaccaaataatataaaaggtggtgctaatttgaaaattggacaaattcggcaatcgctaagcggcttttatgacgtttatgctgatggccaaatgtatcggacccgtgcacgcgggaatttccggaagcggcgcattacgccacttgtcggcgacaatgtggagtttgatgcggcgaccccacaagagggctacgtgttaaatattcttgatcgacagacccagttggtacggccgccagtggctaatgttgatttaggtatcgtggtaaccgctacaacggaacaagaattttcaacgaatttattggatcgacaactggtagctttggcagtggcaggtattgaaccattactctactttgcgaagactgatttactaaccgatgaggtgtaccaacaacgattaacattagcggacgcttatcggcagattggttaccaggtcatctgcgaacgaaccgcattttcaccggccgccttagccgcagttaaaacggctctggctggtcatgtggcggttgtcatgggccaaactggtgctggtaagtcaacactgctaaatcatttacaaccagggctggcgttagcgactggtgaaatctcgcaggcgctgaatcgtgggaaacatacgacccgtaaagtcagcttgatcccgattgcggatgggttggtcgctgatacgccgggtttctcatcctatgaagttttcgatattgccgctaacgagttgacccattattttccagagtttgtgcgacttagcgctgattgcaaataccgaggctgtgtgcatattaacgaaccgcaatgtgcggttaaacaggcattggcagctggggagctgttagcgagtcgctatgataattatttacaattctatgaaaccattaaaaataaaaaagtaatctataataagaaaaagtgagtgagactaatgattaaagttgccccttcaattttaagtgcagattttgcgaaccttcaacgtgacgttcagatggctgaaaatgccggtgccgatgcgttgcatattgacgtgatggatggtcagtttgtccccaacttgtcattcggaatgagtactgtggcggatttacggccagtaacgtcattaatgttagattgtcatttaatgattatggacccagagcggtttgttgggcagtttgcaaaggccggtgcagatttgattggtgtgcacgttgaaagtacccgtcacatttatcacgccttacaattaatcaaagatgctggtgtgaaagccgaagtggtcgtgaaccccggaacaccactcggcatgattagtgaattattgccactagtggatcaagttttgattatgaccgtcaatcctggctttggtggtcaacattttctggaccagatggttgctaaaattgcggcgttgaacgaattgaagcaacaacacggttatcaatttgagattgaagttgatggtggaatcaacgaccagaccgtcaaggcgtgctatgacgctggtgctacggtcgctgttgctggttcgtatgtctatgacagtgcggacccagcgcaacgtattcaagatttgaaggtggcgaccaattaatggcaaccatcgtaaacttactggttggcggaccgactgctaattatccagcagatttaacgacgattccaggaccatgggtcggcgctgaccgtggcgcgttgcgtttggtgaaacgtggtatccagcccgtgatggtcgtaggtgattttgattcaattgatgcggctgaactccagactgtcaaagatgcgttggtgggcgctatcgttgtcaaacccgaccaagaccatacggatacacaattggcgattaaatccattttcgagcagttgcaaccggatgaagtgcatctatatggtgccacgggtggtcggttagaccatttactggccaatatgtggttagtacttgatccggtatttcgtcagtgggctccgcagatcaaactgattgataagcaaaattcggttcggttctttctaccaggggactaccagatcacgaaggaagcggataaacgctatttggcgtttgtaccgctgatgccgatgcatctcacgttacccgatgaaaagtatcagttggacgctgcttataatgcgtacccgatttcatgggccagtaacgaattcagtggcaatactggtcactttagctttgatgcgggggttctagctgttattcaaagtcgtgatgacagcatggcagatgcgtagggtaccccaaggtttcagctaaaataagaccggtcggtgagtcataaactcatcaaccggtcttttaatatgcagtaacgacgtatcatcggggagcttgttggtgaaacgtgctgatgtttaggtcggtggtcgttagtagacctaaccggaaagcttatgttgaagcagaactttttggtcagacccagctggttgtttccgacgatggtacggcaagcatcctcaatgattcaggtcatcataatgggctggtcaaggctgaattataaactttataaaaagttgacgagaaattagtaattttagacaacaaaaaacgccagccacaaaaaatgtgctggcgatttgctgcgctaaacgcgcgtaactttacctgatttcaaagtccgagctgaaacccaaaccttctttggtttaccatcaactaaaatgcgaactttttgcaagttagctttccagctgcggcggctgtggtttaaagcgtgagaacgcgtgttaccaaagtgcgtccgtttgcctgtaacgtagtcttttgccatgttgatctgcctccttcggtaattcattgataaaaggtcgtctttatcattcactagaataatttatcatagattaataaaggttgcaatacatttctatcaagtaattttactttactgctaaattcccagtttccgggcttctgttaagcagtcgcttaatttttctttcaagagtggttgtgctatgataaactatcgtaaatgaacgcgttaaaacaaggaggctattttcatggctgtcaaaatcaaaacgcaatttggaaccattgatattgataatgatgttatcgcgacggtcgtcggtggcgccgcaacggataactacggggttgtcggtatggcgagtcggaaccagattcgtgataatgttaatgaaattttacgccgcgaaaactatgcgcgcggtgtggttgttcgccaagaggataatggggtggctattgatgtcaacattatcgtcagttatgggaccaaaatttcagaagtctcacgcaatgtccaagccaaggtcaaatataacttacaaaacatgcttggcgttacggccaattcggtcaacgtcattgtccaaggtgtccgggtaatgaacgactaaattgatgttggtggaagccaaggaggaattttgaaattgaaaatcaccacgattactaatcttgaatttggcaaaatggtgcaggctgcttcacaaaagctgaaccaacgtgctgaatttattaattctttgaacgtctttccggtaccagatggtgataccgggactaatatgagcttatcgatggccagcggtgccaaatatgaacgtgaagaaaccagtacaaaagtaggcgacctagcgtcagccttagccaagggactcttgatgggggcccgtggtaattctggtgtgattctatcacaaatttttcggggcttttctaaagccgtagcggataaggagagcttaaccgctaacgatttagcagccgccctcgcagccggtgctcagaccgcctacaaggccgttatgaagccgactgaaggaactatcctcactgtcatccgcaaagctgctggtgccggtaaggaagctgttaaaacgaccgatgatatttgtgaagttatggatgccgtcgttacggctgctgaagctgcattgaagtccacgccggacttgttacccgttttaaaacaagttggggttgttgattccggtggtcaggggctgaccttcgtgctggaagcctttagtgactcattaagcggcaaggtcgacgaatcacaggactatgttccggacgatgctgaaatggattcgatgattgatgctgcccaccatcaaagtgtgcaggggcaattagacccgaatgatatcaagtatggctactgtaccgaaattatggtgcgaatcggcgatggtaagttagttgatcacaagttcgactatgacactttctatgagtacttagcaaaattgggcgattcattacttgtcatcaacgatgatgaaatcgttaaggtgcacgttcatacggaacatcctggcgatgtcatgacgtggggccaacgttttggggcgttgatcaaagttaaagttgataatatgcgtctacaacaagaaaccatcatggaacatgataaggaagacgaagcgcaagccgctgctgagcccgccttaccttcacaaccacaagttgacatgcatggttatgcgatcatctctgtgtcatcgggtgatgggatcggcaagctatttaagggcttgggtgtcaccgacatcattgctggtggtcaaacaatgaatccaagtaccgcggatatcgtcaaagctgttaatgacagtggtgcccaacaagcattagtattgccaaacaacaaaaacatctttttggcagctgaacaagctgcggaagttgccgatgtcccagttaaaattatccacagtcagacgatttcgcaaggcatgactgcaatgttggcattcaatgctgaagctgatttagacgataatcaggccgcgatggaagaaaccttgagtacggttgttagtggtcaagtcacacatgctgttcgcgacacgacgattgatggccttgaaatcaagaaagatgattacatgggcttagttgatggcaaaatcgtaattacgaatccagatcgcgataccgctgctttggatatggtcaaagccatgctcgacgaagatagcgaactcgtaacgattatttacggcaaggatgcaactaaaactgacgctgatcatttggcagctaaggtgcaagagttggatgatgaattagaaattgaaattcatgaaggtgatcaaccagtttacccattccttgtgtcagttgaataggactaaccgttaaaaatagggcttagcagtgatgctggggcctgtttttgtacggacggatacttcccgcgggattgaaacgtttttttggtataattaatattggtaaaggcaattattttagaaagggcggtggtcaggcatgggacaacagttgagtgacgcggttgcaactttaagtggtgtcggcccagcccgccaaaaaggtttagcggagcttgggattaatacgattgcagatctattgacctattatccctttcgctatgaagatctacaggtcaaagacgtcaatgaaatcgccgatcaagaaaaggtgacactaaagggtactgtggcttctgaacctgtgctagcacggtttggccgtaagaataatcgcctgaattttcgcttgttaatcgaccatgacgtctatatggtgactttttttaatcaaccatacttgatgaaacagattgagactggccaagatttagccgtttatggcaagtgggacgccacgcgcagtagcttgacgggaatgaagatcatcaatcccaataatgcggattcagcgtttggttcgatttatccggccagcaagacggtcaagcaggggacgattcagaagatgatcaaacaagcatatgagttatatgccccagtcattacggacattgtgcctgctaacttacgtgctaaataccgactgttaccgcggcgccaaatgattcatgatatgcacttcccagctagtcaagccgattcaacggccgctcgacgctcagcgacctacgaggagttcttgttgtttcaaatgcaaatgcaagttctgaagcaaacggacgcgacgacgaacggtattgcgatcgcttatgacaatgaccgactaaaggcgtttattaaaacactgccatttgaattgacccacgcccaaaaacgtgtcgtcaatgaaatttgtttggatttgaagtcaccgaagcatatgaatcggttgcttcaaggtgacgtggggtccgggaaaacgattgtggctgccattgtcatgtatgcggcgattaccgctggttatcaggccgcgttgatggcgccaaccgaaattttggctgaacaacacgcaaataacttggcccaggtctttgccgacacggatgtcaacgttgcgctgttaacgggtgcgaccaagccagctgcccgcaagacattgttagcagcgctggctgctggtgagatcaacttattgattggcacgcacgccctgatccaggacggggtgacttatgctaatttgggattagttattaccgatgagcaacatcgctttggggttaaccaacgggccgcctttcgtcaaaaaggcgggcaacctgatgcactagccatgacggcaacaccaattccaaggacattggcgattacggcgtatggtgaaatggacgtttctgaaattgatgaattaccggctggtcggcaaccgattcaaaccacttgggtacggagcaaccaagctaattcggcgctaagctttgttcatcaacagattgacaatggatcgcaagcctatgtggtgacaccattgattgaggaatccgagacgctggatgttaaaaacgccgaggctctgtcagctaatttacaagagtattttggggcgagtgttaaagttggactgttgcacggtcgaatgaaacctgaggaaaaagacgcggtcatggcggcttttaaggcgggagacattcagttacttgtttccacgaccgtgattgaagtgggtgttgacgtcaagaatgccacaatcatgatgatttatgatgctgaccgttttggcttggcgcaactacatcaattacgcggacgcgtcggtcgtgggaccaaggcttcatactgtattttggtggctgatcccaagaaccagcaagggattgagcggatgcagatcatgacgcagacaacaaatggttttgttttggcacaaaaagacttagaattacgaggagccggtgatgtgctgggggtcaagcaatcgggaatgccggaatttaaagtgggtgatccgattgcggatttgaccgtgctacaagttgcccagcaagatgcccacgcaatcgtgcagcaaccggattggcaaagtcaaccggataatcgggcactagccgcctatttgagccagaagttggctgcggtggggacgctcgattaataacctaaatacagtactgtgatgagaggaatggtgacacaatgattaaaattgcgattgatgccatgggtggcgattacgcccctaacgctgtgatcgagggggtcgagcaggctcgtgatttgtttgaggatacggtctttttattatatggtcaacgcgacgtgattaacgcgcaactgaagaaccgtgatcggattcaaatcatcaatgctgatgaagttattacgatggaggatgaacccgtacgtgccgttcgccgtaagaagcattcatcaatcgtaatggcggctcaggccgtgaaggatggtcaggcggacgccttcttttctgccggtaattcgggggccgttctggcagccgggttatttatcgtgggccggatcaagggcatcgaccgaccgggattagtgacggtattgccagtggtacgcaatgctaaccaatcgaactttgtgatgatggatattggtgctaatgctgatagtaagccactgaacttgcaacaatacggtgtgttagggacgtactatgcagaacggatgatgcaagctaagcatccacgggtcgccctactcaataacgggacggaagatgacaagggaaataaggtccataaggcagcgtttgaactcttgtcacagactgacggtatcaattttgtcggtaatgttgaatcccgggacttgttgaacggggttgctgatgtcgtcgtaacggatggttttacgggtaacgccgttttgaagagcattgaaggtacggcgcgttccatgctcggtttagtgaaagatgccgtctataacaccggtatcagtggcaagttaggcggcctattgcttaagaatgggtttaatgaaatccggtctcaaatggactattctcagtacggtggcgcggtcttactaggattgaaggcgccggtcgttaagacgcacggttccagcaaagcgccaacaatcgtgaatactatccgtcaaattcgccagatggtcagtacggatatcgtcccaggagttgcggaatattttgctaatcaacaagctaatcagcaagcaagtgtagacattcctgctgaaaacgattagaatactttagtgaattcaagttagtgagggatctttacatgacgaaagaagaaattttcgataaaattgcggatatcattgctgatcggttcgaagttgataaagcaacgattaccaacgaaatgaacttgcaaaccgatttggatgctgattccatcgattttgttgagtttgtactggaattagaagacacctttggtagcgaaatctcagacgaagatgccgaaaaattgtcaacggtcggcgaagtcgtcgattacgtggcagcgcaccaagcaaaataagttaattgaccaagcaaaaacaggtagccaacatggttacctgtttttacttgtctgactacgaaagtaccgatatcattgttattgaccactaaatcatagtataatgttatgatatgcaatgtgtgacctgttgactgactgattatcagatgaatccttacttaagcggacctttaacttgtgtttctattttgttagcttctgatcatccacggtcgactgccacggctgggtgagactgaacattgcgtgtaagagtagcactaaatacatgtcggaagcactcgaacggcagatgaatgaccaccttaaataatgattcatgctaagttaggcaccaccagtaacagattgtgataactggctgatccaatggggttagtcgatagaatgataacgaaaggaagtttcaaatgattacagaattagctgcaatgttgaaggaacggtttggcattgtgtttaacgatcccgatttattggcggaggcgtttacacaagcctcgtatgtcaatgaacatcaggaccaacagttgaagtattacgaacgggtcgaatttttgggggatgccgtcttggagttagtggtgtccgaatatttatacaaacgttataaagacatgccccaaggtaagttgactcgtttacgggccgccatggtttgtgaagaaagttttgcaagctttgcccgtgaatgtgactttcctcagtacatccggttaggcaagggcgaacaaaaagcgcatgcttgggaacgagattcacttttatgtgatatttttgaatcatttgtcggggcattgtacctggatcaaggacgggaacctgttttgaagttcgttcatcaagtaatttttcctaagctggatgagggtcgttttgatggcgtttttgattataagacgaccttgcaagaatacttgcaacgggatggcgatgtcgcaatcgactatcaattaattgaacaagatggtccagccaatgagcggtcttatgagattgccgtacttgccgatggtcaaaaaatcggtgagggctgggggcattccaagaaggaagccgaacagagcgctgctcggcaagcttattcacaattacagcaaaagtaaccattaataattacaggaagtttgtgtcgaatgcaacttaaatcattagaaatcagcggatttaaatcatttgctgataaaaccaaaattgattttcaagccggaatgacgggaattgtcggcccaaacggtagtggtaagagtaacattattgaagctattcgctgggtcctcggagaacaggccgtcaaaagtttacgcggcactaagatgaccgacgtcatttttgccggctcggctaatcgaaaaccgttgaatatggctaaagtcacgatcacgtttgataacagtgaccactttttacctttggattacgcagaagttagtattacgcggaaactctttcgtaacggtgacagcgattatttaattaataatcagagttgccggttgaaagatattacgaatttgatgattgatactggtctgggaaaagactcattttcagtgatttctcaaggtcgtgttgaggcggtctttaatgcgaaaccagaagagcgccgcagcattatcgaagatgtcgctggggtcttaaagtacaaaaaggataagttcacgacggagaataaattagcggaaacgacggattatttagaccgcgtgaacgatatcattgctgaattgaatcagcaaaaggggccgttggaagaacaagcgagtcttgcccgggattatcaagatcaaaaacaaaaatttgattatttggaccgttcgcggctcgttaagaagttgacgattgctcgtgatcaactgcaaggtgtcaatgaaaagttagctagtgccaaggcgttagtggctaagtatcagcaacaagttgatgctggggcaaccaagctagctaatttaaaaacccagcagacagctcaattaaagcaaaaagatgagctggtagcacaaaatcttgagctgattaagaccatcgaaaacacgcaaggacaacaaggggttgacgctgaacggcggcaaaaccaacagtctgagcaggaacggctgacggccagtttgaccgcaactgagcaacagattgcgacgcaaaccgagcaacaaacccaattagaacaaacattatctgagcagcaagcccaagttaaggcagtcaaagcgcaagttgccgagttaacgacggcaacgagtgcggccggccgtcagcagttggctgatgagctggaaaaattacgcaatgcttatattgatgaaaaacaagttcaggctgaactgaataacgaagcgaagaacctcgttaagcaacatcaacagtctggcagtcagagcacagcgttagcagaacggctagctcaggctcaggctaacttgaaacgggtgcagacgaccgtggacgtgcacaatcgtgagcaacgtgatttagaaaatcaagtcagtcagcagcaggccacgctaacagcccaacaagcccaagtaaaaacgaatgcagagcggatcgacgagcaacagcaacgttggttagacgcggctggcttgatgcagcgtgaaaagtcacggctagaggcgttgcaagctgttcaggaacgctatacgaacttttatgcgggcgttcgaatggtcttacaacatcgccaacagtttagtggcgttgccggggccgtttcagaactcctgaccgttcctgatcagtatactaaggcggtcgaagttgcactgggcggacagttgcaaaatattgtttgtgacacacaacagacggctaaaactgttgttaatttcttaaaacaaaatcacgccggtcgggcaacctttttgcctatcgagcggatcacggctcgtcaacttcccgttaacactgagcgcgatttatcacaacaacctggtgtgttgggcgtggctagcgagttggtcgattgtgaatcacgattgacggcaatcaaacgttacttgttaggaacaacggcgattgtggacacgctagaccacgcgatggcaatttcacggagcagacgttttcggtgcaaattggtaaccattgatggtgaaacgattgcggccagtggggccatcaccggtggtgcgactcgccatgatgataatgggctactccaacagcaacaatccgcggaaaaaattgcagctaacgttgcccagatgcagtctgaattagtaacctatgaacaagggctagcagaccttaaaaaagctaaccaagacttgacggttcaggttgaaacgacccgccaacaactaagtgaacttaaggatcgccttagtcagacacaggcccagttacaggcggcacagagcgagcaaacacagctaagtcgtcaagttaaggctttaacttatgagcagcaacagacgcaagctgatgatagctatgaagacttagtggctcgtaatcagcaagcgcaagcggctaatgcggctaagcttaaagactatcaggaccaaatgaaaacagtccaacaacagcaaacggattacgaaagttatcaacagactcaaacgacgaaattacaagcccagcgtgaacaactgatcacgttgcaggaacacgtgaaacaaacgcaacgacaattagaacaatgtcaggcgaccttggcgcaaaatgaagagacgaaaaagcaaattcaagcggatttagcagcaattaaaacaacgttagcgagccagcaaatgtcggtcgcagaacgcgatacggtcttgaaaacagctaaggctaaacaggctgcggttgaagaacaacggaaaacgtgtgaacaacagctagcaacgcttaatgatcaggttgaagaattatcgacccagcaagttcggttgcaacaactcgcagcggccgcaacggatgattaccgtcgcttggaattaagccaaacaaaattgactggcgaagtcgaccacgccacggctgatctggctgaaaagtaccagttgacagttgccgcggcacaagctgacgtcagtgacttagcgttacctgcgattacggaacagttgaaactgcttaaacgaggcttggatgagattggaacggtaaacctcggcgcaattgacgaattcgagcgggtcaaggaacgctttgactttctcaataaccaagcttccgatttaactgaagccaaggaacacttactgcaaacaatggctgatttggatacgaccgttgccacccgctttaaaacggcatttgatcaagtcgctagcgaatttagtacgatttttgaacagatgtttggcggcggtaaggctgaattgatcttgaccgacccagaacatttattgaccagtggggttgatatcatggcccagccaccgggcaaaaaatttcagcgattaagtttactttctggtggggaacgggcgttaacggctattacgttattatttgccattttagcagtgcgccccgtgccattcagtatcttagatgaagccgaagctgcgttagacgatgccaacgtggatcggttcagtcagtatttgaatgattttcaaacgggaacgcagtttgtgatcattactcatcgaaaaggaacaatgatgcacgctgacgtactttatggggtaaccatggaagagtcaggtgtctccaagatggtctcagtctccttggcagatttaaaagatgaacaaaaataattaaaggaagtgttgaagatgggactatttagtcggttaaaaaaagcgtttagtttaccagaatcagatgacgctcaaacaacgtcagctgccagtgaagcacctgcaacgacgagtcaagctaacgcaccggtcagtgacgaccgggccccttcgtcacaacagttagctcgctcggagggcgcaacaactgaatcaactgcgacaccggtgtccagtacagccgtaagcgaagcgacaagcactgcggacgaaccagcgacagtaaaatcggcagctactagtgaagccccggccgatagcacggcggcagtgagtgcacagtctggttcacaagcaccaatgcaatcggcgacggtgtcggaagcgccactcacagccagtgcaatggttgcccagtcactagctgcattaagtgcgagtgcggcacaagttagtcaagcggccgcgagcgacgtggcgttagcgactaagtctgatgcggtagttgaaggcaacgctatgtcagaatcagtagctagtacggcgccagcagtcaagtcatcagcgccaacagcgactgaatccgccgcaccgactgttaatgcggcggctgattcggaatcggctgagccggagccaactgaggcagaacgttatgatgaaggactgaaaaagtcgcggaaaacgtttggtgatcgtatcaatgccttcttggctaatttccgccatgtcgacgaagcgttcttcgatgatttggaagatacgctgatcgaatctgatgtgggttatgagaccgcgatgcgaattagtgacgagctacgtgacgaagttaaattaaagaacgcgaagagcaagaaagaaatttcaagcgtcatcgtcgaaaagctcgttgatatgtacggtgaagctggtgaaggcgaggataactcgattcacatggctaagagtggtccaaccgttattttatttgtcggggtcaatggtgctggtaagaccactacaatcggtaagatggcgaacatgtacaagcagcaaggcaagaaggtcttgttggcggcttgtgatacgtttagagctggtgcaatccagcagttgcaagtctgggggcaacgagacggggttgacgtggtcgctaaggccgaaaaaagtgatccagcggccgtttgctttgacgcggttaagaaggctaaggccgaagattatgacgtgctctttgtggacactgctggtcggcttcaaaacaaagtcaacttgatgaatgaattggaaaagatcaagcgggtcatcacccgtgaaatccctgatgcaccacacgaggtcttactggtgctggatgccacgactgggcaaaacgcgctgaaccaagccaagttgtttaaacagtcgacggatgtcagtgggattgtgttaactaaacttgatggtacggcacgtggtgggatcgtcttagctattcgtaatgaattgcatcttgctgtaaagtacgttggtttaggtgaaaaggtgactgatttacgaccattcaatgccaatgactttgtctacgggttatttaaagatattatcacgggttaaatcagttgatgatggtcttaaattgaaagccagttaacgaaatggtaattgttctcagcacgaggacgattactatttatttttaccacaaatagcgactgatagttgacgaatggcgataaaatcggtactcttatttagtgtgtagtctgtatgataagcgtgaggagtccccacatggaaattgaaaaaaattatcgaatcaattcgttattcgagttttatgaaccgttattaacgaataagcaaaaagcctatattcaactgtactacgctgatgactattccttaggcgagattgcagcagagttctcagtttcgcgccaggccgtctatgataacatcaagcggaccgaaaagattttagaaggttatgaggctaagctgcatctctaccacgactttgtggaacgtaatcacgaagttgacgcgatctctgactatattaagcaaaattaccatggggatacccagttaattaagatgattcaacaactagtcaacttggaagctgactcagaataataataaaggttaggtgacactaatggcatttgaaggcctaacggaacgtttacaaaaagcaatgaccaatttacggcgcaaggggaagatttcggaaagtgatcttcgagcaaccatgcgtgaaattcggttagcattacttgaagccgacgttaactttacggtggtcaaggattttgttaaaacggttcgcgaacgtgcgctcggcgcaaaggtgctggaaggtttaaatccagcccaacaaatcgttaaaatcgttgatgaagaattaacgaaaacaatgggtgaaaaggcagttccactgaacaaatcgccgaagattccaacggtcatcatgatggctgggctccaaggggccgggaaaacgacgacggtcggaaaattagccctcaaattaaagaacgaacaggatgcccgaccattaatgattgcggccgacgtttaccggccagccgcgattgaacaattgcaacaagttggtcgccaaatcgacgttccagtcttccaactaggaaccgatgtcgatcccgttgagattgtgcgtcaagggatggcacaggcacaagaaaaccacaatgattacgtttttattgatacggctggtcggttacaaatcgatgagcagttgatgaacgagttggccaatattaaagatctcgttcatcctgacgaaattttgttagtgatcgatgcgatgactggtcaaaacgccgttaatacggcggagggctttaacgataagctggatgtgaccggggtcgtcttgacgaagttagatggtgatactcgtggtggggctgcactatcaattcgggccgtcactggtaagccaatcaagtttgtcggtcaaggcgaaaagatgactgatcttgatgtcttccatccagaccggatggcggatcggattcttggtatgggtgatatgctgacgctgattgaaaaggcgcaacagcaatatgacgaaaaacaagccgaagaaatgaacctgaagattcaggaaaacacttttgacttcaatgactttatcgaccaattagaccaagttgacaagatggggaacatggaagatatcatgaagatgattcccggcatggctaacaatccagcgatgaaaaatatcaacatggacccgaaagacattgcccatatccgggcaatcgtttattcgatgaccaatgccgaaaaagcagatccggatttgttgaacccatctcggcgtcgacggattgcggctggttccgggcggccaattcatgaagtcaaccggatgatcaagcaattcaaccagaccaaaaagatgatgaatcaaatgtccaaagggaactttgctggtatggaaggtctcatgggtggtgccaatggcggtggcggtatcggtggtaagatgcaacaaatggccatgaagcgaatggttcgtcaaactaagaagaaaaaacaaaagcgcttagccaaagcaatgcggcgtcgcaaacgctaatttataagtttttttagcctgtcaagaaaaagtcctttacaagctattgatttactggtatattattacctgttgaagaattcgggaggtgtttaaatgtcagtcaagattcgtctaaagcggatgggttctaagaaaaatccattttaccggattgttgtcgcagattcacgttcaccacgtgatggtcgttttatcgcccaagtcggcacatacaacccacttacagaaccagcccaagttaaacttgaagaggaagatatcctcggttggttgaacaatggtgcccaaccttcagatacggttaagaatatcttatctaaggccggtatcatgaagaagtaccacgaagctaagttcactaaataataaagcggtaatagatcatggcagatattaaagctttaatcaccacggttgtcaccccgttagttcaatatccagacgatattaaagttgattttaaggaaaccacgcgttatcttgaatacaacttaacggttaatcccgaagatatcggccgggtcattggtcggcagggacgggttgcttcggcaattcggacaattgtgtatagtgtccgagtttcaggacctaaacgtgtccggcttacgatcgaagacggacaacaaaaaaactcttgagcgaagcagtgatgttttgtttaagagtttttttatatcttgttccggtttttgaggacgagtcaaagtatctcgatgaccgtcgttgagtagattagttgtaacatgttgatgacatttaaaacgaataacaatcaagctaattaagaggaggaagctaatggattactatcgtgttggcaccctagttaacacccacggcattcgtggtgaagtgaaagtcgttgtcgtgactgattttccagaagaacgctttaaagtagggcaacaattgaatttatttaaaaccccagatgaaacgactggcgggattactgtcaaaatcgcgaaggcccgtgagcaaaaggggctgtactttcttacctttgaagggctcgataacatcaatgatgtggagcgctataaggggtggacgatcaaagttcctgctgaagcattacatgccttaccagcgggtgagtactactatcaccagattgtcggcctacaagttgtgacgaccgctgacgagcctttagggactattaaagagattctgtcacctggtgcgaatgatgtttgggtggtcaaacgggatcatggtcagtctgacgtcttactacctaagattccccaggtcattaaagatgttgacttggatgcgggcgtggtgactgttgaactaatggaagggttgattgattaatgcaaatcgatattttaagcctgtttccagagatgtttgcggggccgcttcatgagtcgatgattggcaatgccattgaaaatgacgtcatcaatgttgatgtcactaattttcgggattttacgaccgacaagcataaccatgtggatgattatccgtatggtggtggtgcgggcatgttactccaaccacaaccaatttttgatgctttggccagcgttcaggaaaaacacccggcacccggtcgcgtgatcttattggatccggcgggagtccagttcaatcaacacgttgctgaagactttgctcaggaagaacacttgacctttatttgcggccactatgagggttatgatgagcggattcggtcattagtcaccgatgaagtctcgctcggtgattacgttttaactggtggtgaactgggtgcaatggtcatgattgatgcgacggtgcggctcttaccaggtgtgcttggtaattcggaatcggctccgggggattctttttcgagcggtctcctggaatacccacaatatacgcgtcctgctgattttcgtggtatgaaggtaccagatatcttactgagtggtgatcatggaaaaattgatgattggcgcttagaacaggcgctgaaacggacctatgaacggcgcccggacatgttgacggggctatcattgtcaggaaaagctaaacagatgttagcagatatcaaggcggatgagtcggaagtgtaggctatgccgttaattaggacaagttagtcgtgaagagttcaaaaaaacttgcgtgcccaccctcgaatatggtattctatttattggctattgtgcccattaacgatgttccgctgaccaggttgtcacgaatgtcggcgaaaggaagaaatacattatgcgtcaaaaccaattgatcgaaaagatcaccaatgaacaacttcgtacggacatccctgatttccgtgctggagatacagttcgtgttcatgcacgagttgttgaaggtactcgcgaacggatccaattatttgaaggtgttgttatcaagcgccatggttccggtatcagcgaaacttatactgttcgtaagatcagtaacggtgttggtgtggaacggacattcccattacacacaccacgcgttgccgcaattgatgtcgttcgtcaaggtcgtgtacgtcgtgccaagttatactacttacgtaacttacatggtaaggctgctcggatcccagaacgtcgtcgtggctaaatcacaacgtcaacaatcatcggttgcagcttaggctgagctgatgatggaaagctagttaatcatttttaatgattaactagctttttttattggcgaagttagtgacacgctcaatcgtcaaatcatcgaccaatttaggtcggttcacaatgtgagcatgctgtgcttggatttataatttaacaatcttacgagatagctcgtaattcctaatttgaagtattatgatagtaatacgattacgcgatgcttcttgggatgcgtcaattagctgaatatgaatcacttgatatcagactaaactgatttatttgaacagggttgtcgcgtacctgacgtgtataactagtgctaagctggcggccgggttaactaaacgggagattgctcaaagcgagcacgataaaataaaagagagttaggtgaaagccgatgtttggatgtacggggaaacatcaggtcgatgaacaggcgttattgagtcagttagttgacttcgttctcgacactagtcttaccgaccgtgaacgtaaaatcgggttgatggccaaagccgatttggagcatcatcgctattcaattgctgtgttaaataaattagtggttagttttcaaatggaggcgctacgcaacaagggcctttcgaaggctgcttcaaacttttatgatcagatttatccaatattagtcgcggccaaaccaatgggaacgaatttaggctatattgggatgcatagtacctatttagattagggtgtgtcagtgatgaagttactagcgaaaccagaccgtcttcagacggctgacgatggtttttgaacgtaagaggctggcgttcatcggaagtgtgttggtaacagcttaaatgagaacatcgtgcgcatgtccgtgcccctttgaatgaaacctattcagaggggctttttggtgtggaaaaacagttcatgatctgcgcgtcttaacaatattaggtgatatggttggcgggcgataaaaattgtttggtgctgctaaatagctggtaaacgattttggccgtagaacaaatgctatacattgtttgataagtaccgaactgggatgtggatgagccagattcaaaataagtgtgtcaatatgttggttatatcagtattttaatgcagtgttatagcgtgaactgatactacaattaaataatctcaaaaataatttcgtctattttttgttatgcacttgttatttcaacttatttgaacgtatactaatgattgaaggggtcaattaggtgatagtttgatgattaacacaatcgtttcggcacggtacgaaacgcaccaaatattactcagctaaataacttgattgctccaggtacggttgaactttggaggcagaattatgcggaatcgtttaaataagttgggattggaaagtaagtctcactataagctttataaatcggggcggcgctgggtggctgctagtatcacagtattttcagttggcatcggtttgacttttagccaagttgaacaagtgaaagccgcaacgggtacgggggttgacacggccgacaatagcgctagcgttagttccgacatggcagaaccgagcaatgccgtcgtactaaaatcagctagtacggcgacagttactaagaccgcgactcaggatgcaaaagctgctactgatgtaacggccgcgactcaggatactaaagcgactactgattcaactggggcaacatcagcttccagtaatcgtcagtcgacagcagctacgaagccagctgccgaagtcggtactgcttcaagtcgcgctgactcaagtgctagcatatcaagtactgatggcgcaagtgctagtgcaccaagtgtcaccagtaaatctactgacacggaagccacatcagcatccgtaactaaaacggctactacgagtgctgacacagatgtgctaaacactgagacgacaagttcatcagtggcaaatgatctcactgatgctacgacagctagccaaacgcgtacggaaactgggaaaacagccagcatacctactgctgaagcaccgaccattacgactgcggtgacaagtcgggcactcccattgacgggtgcgctagcgagcaggtcagcaaacacgccggtcactaagtctacagtacaggcggtttcagctatcaccagtgaagctgaaacgaagccgaccgtatcgttagtaactacggggaccgtgtcgatggactatggcgaggcgtcgctggcggatctagaatctcatattagttctccagatgagacgccggctaacgacgtcgcctactacattcaagatgcagcgggcaattacttagaagatgtaaacggcaacaaggtcaatttgctatatgcactttttctggactctgctgatgtcaatgattacgttgatgttgtgtatacggatgaacatgggcaggtcacgaaatattccggagatacggacttttcaacgctcgaccaaattggtagttactcagtgacgatcaatgcagcgggtaaagctgggatgagccgggttatgcaagactataatgcttacgatacctcgaccagtgatttggatgactttgtcccaaccttttcgactggggcctccgattatacctttacaattaacattgtccctgtaaaaatcacagccaccactggtaagaatgggctaattatacttcggccttcacagttgtatacgggatcattgacaatgttgccggtagtcaccgttaaaaatgcaacaaagcaaaatatccttcaaattagtaacggcgaaatcggcgatgctaaaccaggcgtagccggcaaggtcggtcaacgtgttttaacgttggcagattttacttatacgtatcaaggcaccgaaactaacttgaccggtgcggacactggcaaatatgcaatcacccttaatgacgctggtcggaaggcagttcaagctgcgctggggtcgaattatattctggatgatgcggcagttttcaccacgactggtgcggtgcaggctgctggtctcaggttaacgatagccaatgatacagtgacctataatggcaagcctcaggggacatccgtagctgtaacgactggaaccgtgtatgatcactttgattttactacgacgactgacacgaacgtcggtacctatgacaacctgacatacgcgttagcggatcccacgcaagcggcgattttggttaaaaactataccgttaccacgacggatgggacgttggtgatcacgccagcagatctgacagtcacggtcaaggatgataatgcagtttatgacggccgagcacatggcacgactgcaactgttactagcgggaccaattatgatcagttagcatttaccgcagttgcagcagatggcagtggtgcgacgacttatactacggtcggcacttatgcaatgactgggactacggcagccgataccagtaattataaaatttcgtatgtcaatggaacgctgacaattgatccagccaaagcaacaattacgattcccaacaagatttattggtcggatgggacgcaaaagaatttggcggcggtggttactgggacagttaatggtgagaccttaaagtatcgtgtgaccaacggcatgagtgcggttggaactaagacaattacggccactcctgatgctgatgattcggtgaataaaaactataccatttcagtcattcctggcaccttgacaattggtgatattgcggttaagtacctctacgaacatgtagatgctaatggtgagactcaggtagatgcttcggaaactggtacggcgacacatgctacggacgcaacggccacggactatttgacctacacgacggcagccaaacccaagacgggctatgtgttagcacccaatactggactagcctataatggcacgttaactgatcagggcggtaccgtgacgtatcgttatttggccaagactgaaacggcgatcgtaacgtattttgaccaaactgataacaaggttattaagacggaacccttacaaggagcgtacgggacaacggatgcgtatcggacggctgatacgattgccgcgtatgagaatgcgggctacgacctggtcgatgatgactatccaacagccggggtggtctatgatcaggacggcagtgttcaagagtaccaggttacgcttgttcataaatttgtaacacgcacgccagataatccgggtacgccaggcgagccgatcgaccccgataatccaaacggacccacatatccagcgggtacggctgtgcaagacttgattaagcaggttggtcaaaccattcactatcagtatcaggataaaagtactgctgccgacgctaatacgcaaacaatcactttcaagcgcagcgtgacggtcgatgaggttaacaataagctaacttataccgattggttgactggtacggcaacgactggtcattacatgccagtcgattcaccggaaattaagggctatgttgctgattcaacgcgtattgcgggtaatgacgaggtgcacaatgcggatgctgacacgaacatcgtggtcacgtatcaggctaagccagagaacgccacggtcacgtatgtagacgtcactacgggtaaaacgctcgctataaaaagcttgactggtgactatcagactacgtccagttaccggacggctgaaacgattgcgagctatgtcaagaatggctatcaactcgtacgtgataactatcccacttcaggggcggtgttcgacgtcgataattttgccaaaacttataccgtgacactgaagcataagttagccacggttacaccagagaatccgggtacgccgggccaaccaattgatccggacaatccagacggaccgaaatatccagtaggaacgaccgctcaagatctgacgaaacaagttagtcaaacgattaagtatcggtatcaaaatggggcttcggctggcactgacagcgttcaactgattacgtttaatcgggatgccacgattgatgaagttgagtctaccgtagtttatactgattggctggatgggacttcagctactggtcgttataccaccgtgacgtcacccgtcattactggctatacggctgataaaacacaggttgctggtcgtgattcagttgctaatacagattcagacacacaggtggtcgtcacctatgcggcaaaacctgaaaaagcaacggtcacttatgtggatgtcacgacgggtaaaacgctcgttacggccaatttgactggtgactatcggacacaatccaattatcggaccgctgaaaccattgcaggttatgttaaaaacggttatgaactggtacgtgataattatcccgtatcggggatgctgttcgatgtcgatgattttgctaaaacttataccgtgacactgaagcataagttagttacggttacaccagggaatccgggtacgccgggccaaccaattgatccagacaatccagacggaccgaagtatccagtaggaacgaccgcccaagatctgacgaaacaagttagtcaaacgattaagtatcggtatcaaaatggggcttcggctggcactgacagcgttcaactgattacgtttaatcgggatgccacgattgatgaagttgagcctaccgtagtttatactgattggctggatgggacttcagctactggtcgttataccaccgtgacgtcacccgttattattggctatacggctgaccgggcgcgggtcacgggaaacgatgcagtaactagtgcggcgcaaccgaccaacattattgtgacgtatgcgattaacgcagaaaaggcgacggtcacctatgttgatgtcaccacggataaaacgctcgcgaccgtcagtttgactggcgattatcagacatcatccgattaccgcacggctaacacaattgctgattacagtaatcagggctacgtgcttgtccgcgatagctatccagtttcaggagctattttcaatgatgatggtgtcgttcacagctatctggttcagcttgcacatgtgacaactgcgacaaccgagaccaagacaatcacgcaaaccgtacattatcagagtacgactggcacgcagttgcacgatgatacggtcagagcgatgacattcactcgtactaaacgggttgatcaggtcaccggggacgtaacgtatagcaattggtcgactaatcaggcggatcacacttttgagcgcgtcgcggcgttcagtattccgggctatcatgcggtggtaacgggtactcaggcagtcatggttacgccagctagcgtggatgatgttcaaacgattcgttacgttaccgataggccttcaaccggtgagacaccaaaaacaccggtgaagacggtgacagttaataagtcggataaaattaagacgactgacacgccagataaagtcgcaacggtcaagacgccggataaggctcagaccgtcgcaacaacaactgctaaacaagctagcgtcaagcggtcagtggatctcaaacaagcacaggctgttgaacagcctgctcagacacgaccagccaatgtaaaaacggttaaactggcgaagacgactaaatccgttaagccaaccgcggctcatcaatcagccacccacaaacaagcgattttaccgcaaaccaatgataatcggcaagctagtgttgcggcggaactacttggtttgaccgcagcaaccttactagttggtgtgagtgcaattttgaagaaacgtcataattagccgttaaatggaggcgttaatatgactactttaatcgatatcacgggtcagaagtttggccgcttaacagtcattagacgttgtggaactgccaaaaatggcaatgccctctggttgtgtcagtgtcgctgtggcaatcagaccaaagctgattcgtacgcgttgcggcatgggcgagcaagaagctgtgggtgtttgacacgagaaagtcggtcgcagttaattcgacgtaatcccaaaacggctgccagtatggggcggttaagcaatctgaaaattcatgatcatcacactgatttaccgtcaaagattatgtctaagcgtaataagagtggtgtcatcggtgtcagctgggatagcaatactcaaaaatgggtggcgacatttttctacaaggggcgctacctgttacacaagccgtttcagcattttgaggacgctgttcttgcccgccaggcgatggaaagccgttatttaaataacaaagtgtaaattaaagttcttccttgatagggcctgatgccttgtcagagaagaacttttttgcgttacagcaacggtaccagcttcttaattggacttagtggagttctttcagaattgtaagtaacaaaaaggcctaacatgggaatgccagcggataaattgtgcttgatttatggagatgaaaattcctaaatgatttgcttgtatatgacaattattaaaaataagacggtccctgatcgaactagaatcataagtatcttgggggcaggtgatttaacggttcttggttgcaatatgttttttaatcaacagtctgatgaaacttgccctagaagttgaggttaactgatgcttctggatcggtgaaatcgttagtttcgtgatggaactagtcattggcgacagaagcgttaatcaatgagcaacgtaccgctccggtttcgaattttcggacgattccggtataataaacgtaactgatgactagggggataatcacatgattgaaattcacgaattaacgaagcgttatggggataagacagcattgaatcagcttactttaaccatcgcatcaggacaaatcttcggtttgttgggccacaacggggcggggaaatcaacgacgatcaaaaatttagtcagtatcattaaaccgacgagtggcacggttacggtcgatggcttagaccttgaacagcaacgacaagccgtcaaagaaaagatctcttacgtaccggacacacccgatatttttcttcaactttcggcgatggaatattgggacttgatagctgccgcttaccagcaatcagaggaagccgttcagcaacggcgacagcagctggtgtcactgttcgatatgactgaacacgttgacgaacccatggctagttattcacacgggatgcggcaaaaagccattttgattggggcgttgcttcccgatccagatatttggattttagacgagccgctgcaagggttagacccccaagctgcttttgatttaaaaaatttgatgaaggcccatgctgccaaaggcaagacggtcattttttccacccacaatctggatacggcgcagcagttatgtgaccgattggcaattttgaagcaggggcaattgatttataccggttcggttgaacaattactagctcaacatccgcaacaatcacttgaggcgatatatttacaaatggccgggcggttgacggatgatcaccttgtcgatgcgctggagggtgagcatgatgcataaaagtcagttacgtgttttgttggctgttaatctcaggttgttgaatccgcaactaacggatcggctacgtaaaaagggcgcttcggggccagccttgagtaagaagctaatgcggcaattttacttgaatgccttgatgtttcttggcatttatggcttgacgatgttggcctttgattttagcaagttgccaggcatgtttacgttctatgtggcgttatttatcttattgggagtttcacagagtatctccggtatttataacgtcttttttgccggcaatgatcttgttgaatacttaccgttacctttccgcaatcaagaaatttttatgagtaagattttggtcgtgatattcaacacggtaccctttaccattccgttacttttaatttttatcatgaccgcaacacgggccggaatctttgtggtgttaggtgtgctgatggccgtcttgatgtatggcctaatactgagtctgttactatgcttgtgcgccctaatagtttttggcttaaccaagctaaccgtgtttcgcgcccatcaaaaaatggtgatgaacgtcatgttaggccttaacgctgtcttagtgctagtcgggctctacttcatgaatcacggctcatcatctgacaccggaacgcaggttgaccgcgcagcattacccctattgataccgatttttaaagttttcacgatgccgttgacaatgacgagtttgctaacctgggcgagtttaattgtcatctcgctgattttgttcgcactgacaggacggtttgttttgatccacttagcggaacagcttacgcaagtcaactcagtgttagtggcaacaccaccgcgtcgacattcacgacaacataaccgcaataaaattttgcgtacctaccagtttcagttactgaaagaacccagtttagccttacaattattcacagattcaatcctgctgccattgattttagtcgggaccgttttcttttcggggaccgctcctaattttagccggctatcgctgaactggctcggtgtctggtttgtcagtgggatggccggtgcgatcgtcaatgttaatcaaacctcattagtcggtaatctcatttcacttgataaaatgaactttgactttgtgcgtgcactgccaatcccaatgtcccgttacttacgacaaaagttttacttgggttattggttccaggtcatgattaatggcgtgatggttctagtggtgggtatcgctgggcgagcaccattagccctagatttggctctaatattgggcgctgcttgggggacgtacctagctgcccaacattactttaagcgtgattatcagctacggctgacgaattggactaatgtgacccaattgtttaatcggggcggcggtaatcttggtttgatgcttaacttgttggcctgcagtattgtgggtgtgctgacaattgtgatctatagtgtgctgattcagctgttcgcggcggcagctatgctgattaatatcattgtattagttggcgtcggaattatttctgctggtttggtctggcattactacaagactttttggcagcaacttgactaataagtgttaatttcacagtcacataatattaaattaagataaaagtgttgacaaattgctcattgagttttaatgttaatgacaacttaatattcgtccatgaaaccgatgaagtggagatcaagataatgatgcccgtaaagagagtcgccgttgctgagagtgcgatcgaacgcaaattatcaaatggaccactgagggcgcgactaacgaacagttttgttctactacctcgcgacgatagggagtcgtcaattcccgggaatgtgtttgcatttcgctaagctgggacccaagtctaacctgaatggggtaatttggtgtccaaccaaggtggtaccgcggaaaaatccgtccttgactgtcattagtcatggacggatttttttgatagggggcagttcaatgcagcaacgatggcaattaaccacaactcaagtaaaactatcttattaatgaggagtggttcaatatgaatccaacattaccaaccttgattccttatcaggatcattatccctacgtaccagtgatggtcaaacgaccactcgtcacatttgaccccattgcggttgctaaaattatccaccagatggggaacggtttcgcgctgacgattgatcggcaccaacgatatagctattttagttttaaaccacagcgaagtctcacgggtcggcaactagccaagcaccaacgaccagctaatgagacactccaagccattctaaaccaatatcgaacaccacgaattcatggattaccaccatttacggggggcttgataggatacttcggctatgagtatgttcaacaatttgtacccaagttgcatttgaaatcaccagcaaccgcagatctcgatgacttaggtttattcttagttacgagtgtgctcgtctatgatcatcgacatcatgagcttgggttgacacagctgattccaactgcggatttagcggcaacttacgccgtgactcaaacggctctaacgcaacagttagccgccattattgaacaattgcagcaaccaatagctttgccaccatttgacttgcagcaaccattacacatgcaagtggaccaagcgacctatgcgcgtcaggttgaccgaattcgccaacacatctacgctggtgatattttccaaatgatatatgctaatccatgtttggggaccatgagcgggtcattgctggcagtttatcagcaacttcaaaaaacagcggccccgtatacctgttattttaaacaggctaatttcgaaatgacggtggcctcaccagaaacgttagtaacgaaggatggggaacaagtcgcgacgtatccattggccgggacgagacgccgtggtcgaacacctgccgaggatcggcagttggctcatgaattacaaaccagccctaaagagattgccgagcacaatatgttagttgatttgggacgtaacgatttaggacaagttgcaaagtttaaaagtgtccgggtgactaatttacggcgattaattcgttattcgcaagtcatgcacttagggtctcgagtggccgcagaagtggcgccgactactacagcactccaagtgcttgccgctacttttccagctgggacgttagctggcgcgcctaagattgaagcaatgaccctgattaatcattatgagcaggtgccgcggggtgtttatggtggttgctttggttacttggattgtaacggtaatttggacatggcgattggcatccggctggcctaccggataaatgaacggttggtgattccagcgggtgcgggcattgttgctgacagtatcggcgctcaagaatttaaggagtgccagaataaacaacgagtgatcgttaatgcagtacaagacgcgaaaggacgagttaaagatggaattattaattgataactatgacagctttacttataacttgtatcaactaattggtcgtctgacgcccgatgtacgggtcattaaaaatgacgatttgacggttgctgcaatcaaggcattacaacctgaccatatcattttatcaccagggccggggacgccatcccacacgggagttagtccacaagtcgtgcaacaattagctggtcaggtccccatattggggatttgtatgggattagaagtgatggtcaccgcttttggcggttcgctgcaaggcacccagcatttagttcacgggcaagccacgttaatgcacgtgcagccgtcatcactatttaaagattgtccgatgcagttcatggcagcgcgctaccactcgttggtagctgatgcgggccgtttgcccgttaactttcgaatcattgggacaagcgatgatcaggaaatcatggcagtggaagatgtgggccgtcagctgtacggcgttcaatttcatccagaatcaatcatgacgccagccgccgttggtgagcaactgatccgtaattttttagcacttaaacattaagcagacgagagtggaggaatacttatgattgaaacagcgattgcacaactcactaaccaagaaaatctagactttacaatgagccaacaagtcattacggaaattatgaaaggtcaggccaccgacgcacagattgggagctttttgaccgccttagccatcaaaaaggcaactatcgatgaaattgctggtgcagcaactgcgatgcgttcccaggcgttaccttttaaagttaaacggcccacgctagaaatcgttgggacgggcggtgaccggtcgaattcgtttaatatttcgacgaccactgcgctagtggtcgccgctgcgggtgtaccagtgaccaagcacggcaatcgtgcggcgtcgtccaagagtggtgcggcggatgttttagaagcactcggtatcaaaatcgatctaacgcccgctcagagtctagcattgctagagcggaccaattttgcctttatgtatgcgcgcgaatatcatcaggcgatgcgatttgtcgctccggctcggcaacaaatcaagattccaactatttttaatatactgggtcccttagccaacccagctcatgctgagatgcaactattaggggtataccggcaagctttaatggctccattagccgaagtgttgacgcgtttagatgttaaacatgccatggtcgtgcatagccgagacggcttagatgaaatttcagcggcagcccctacggatgtgatcgtaattaatcatgggcagcaagtaacgcgaatcctgacgcctgaacagtttggactgacgcgttgtgaccatgcggctcttattggtggtagtgcccaagttaatgccgccatcacgcgggcagtactcactggagaaccgggggcccctcgtgacgtggtgttgatgaatgccgccgcggcgttgcatattgccaagccacagttggatctagcggccgcttttgagttggcccagcaaacaatcgatcaaggagcggccgcggctaagttggcccaattaattcagagtagtcaggcggtgatggcctcatgattttagatcaactcgtccaggcgagtcagcaacgggttcagaaggtgccagttagggagcgtgtgaagcgcattcaacaagctcgaaaaatgaccacccccgttttatcatttgaagcaatgctggcccagccgggcttacagcttattggtgaagttaagcgggcgtcaccttctaaggggctgattgcggctgagtttgactatttacagattgcgcaagactatgttactgctgggatcgatgccatctcagtgttgaccgaaccccggtattttaaaggacagttgtcttacttacaagccattgcgcaaacggtctcggtacccacattacgtaaagattttattgtagctgctagtcagattgcgagtgctcgtattgctggtgctagtgcggttttattgattgttgctattttaacaccggttcaactgcaggctttcattacgttggctcatgagctgaatttaagtgcgctagttgaagtccatacaacggctgagattaagcaagcggtggcggctggggcccggattattggcattaataatcggaatttgaaagatttcagtgtcaattttgcaacgagctgtcagttacggcaagcagttccagctgagtgttatgtggtcgctgagtctggtattcaaacggccacacaggctcaacagttggccgctgctggctttgacgccatgctagttggcgaaacattgatgcgtgcaccagataaaggtcaagccgtcatgcaattgcgtgcgggggtgcgtggatgactcaaatcaaaatttgtggcttaatgcgaccagcggatgtcgtgatggttaatcaagcgctcccagacgcaattgggatggtatttgcccccggtcgtcgacgacggattacgatggcgaccgcgcgccaactgtcacagcaattagatccgcgtatccggcgtgttggcgtgtttacaactaatcaattatcggaaattttagctctcgtgcaacaacacattattcaggtggtccagctacacgctaccgtcgatgatcctcggattgcgtccttaatggccgcccatgtgccggtgattcaagcgatgacgccagcgaatgctacgcaatgtcaagcggattacttattattggataatgcccgtccaggtagtggacaggtgttggattggaatcaattacaatcacagcgtcccgtccggccgtttatcttggctggtggtttaacaccgacgaatatcgtaacggcaatcaacaaggtgtacccggcaatggtcgatgtggctagtggcgtcgagacggcgggcaataaagaccgtgaaaaaatcaatctgatggtccaacgggcgcaccaaacgggcgtgtcaacaccattattaacagaaattaggaggaattagtatgattaaaaatcaatcacaggcggggcgttacggcgactttggtggtcagtacgttccagaaacattaatgaccgagctacagcggttggatcgcgcctttcaacattaccgacaggacgcgcagtttcaagaagagttgactgacttgttgaataactatgcgaaccggccatcgttgttgtaccatgcacaacgattatcagatcaattaggtggtgctcagatttattttaaacgtgaggacttgaaccatacgggtgcgcacaagattaacaatgtcttggggcaggcactgttggcaaagaagatgggcaaaaagcgattgattgctgaaactggggctggacagcacggggtcgcaactgcaactgttgctgctttgttcgggatggaatgcgacgtctttatgggtaagaaagacacggatcgtcaagcattgaatgtttaccggatgcaactattaggggccaaggtccacccggtcacgactggttcaatggtgctaaaggatgcgatcaatgcggccttacaagagtggacgcggcgctgtgatgatacagcttatatcatgggctctgcaacgggaccacacccatttccaatgatggtacatgaatttcaaagtgtcatcagtgtagaagcccgacagcagatcctggaccaaacaggtcatttgccggatgccgtcgtggcttgtgttgggggcggcagtaacgccattggaagttttgcggcttttcttgatgatacgtcagttgagctgattggctgtgaggcagcgggtaagggtgttcaaacgccgttgacggctgcgacgattgaacgtggtcggactggtatcttccatggcatgaagtcactctttttacaagataaagccggacaaattgccccggtctattcaatctcggctgggctggattacccgggcgtcggaccggaacatgcctacctggctgcgagtggccgggcgcaatatgtggggatcaccgatgaccaagcagtacaagcatttgaactgattgctaaggtcgaaggggtgatctgtgcgattgagagtgcccatgcagtcgcctacgtacaacaattagcaccaacgatgcgacgtgaccaaactattatttgtacgttatccggtcgtggagataaagatgtggcggcaattgcaaagtatcgaggggtgacaattgatgactgatttaacaacaatttttaaaaatcataaggcgtttattgcttttgtagtggccggtgatcctaattttgaagcgacagttgaccaagttgttgcgttagcagaagcgggttgtgatctcgttgagattggcattccgttctcagaccctgtggctgatggtcccgaaattcaggccgctgatctccgtgcgtttgaccaacacatcacaccccaacgcgtttttgaattggtggtggcaattcgagagaagacaactattccactcgtatttttaacctatgcgaacattgtttatcagtttggttatgctgcctttgcccagcagtgtcaaagtttgaatgtcgcaggcttgattattcccgacatgccactagaagcctctggtgaacttcgaccaaccttagaccactatggtattgctttgattccattgattgcgccaacgagtgatgatgcacgcatcgcagcgattgcccagcaggcgcggggcttcatttatgtcgtatcatcactaggtgtcacggggacccggcgacacatcacgactgatttagcaacactggtggcgaagattcgccatgcgactacgttacctgtcgcaattggttttggtatccatgagccagcccaggcccaggccatggcacaaattgcggacggggtcatcgttggtagtgcagtcgtgcatttgattgcgacgcaccaaccagcgacagcagtcttaagagactatacgcgacggatgcggcgcgcattggatggtcgcacggctgatacagttgactgatcttgtttgttacgatgttgttgtgccgggctacttcgattaaatgctgggaaacgctaggataatgtgctagtctaaaaacagcttactgctttgtgggcgtcgttaataatagttgacgctaaccaagccagttaaattaatttaaggagggctcgacatggcggatgtactgattattattgatatgcaagttggtgtctgtcgtgggtcccaaccggttgccaatttggcaaccgtgattgcgggtattcaacagcgcattacgagttatcgggctcaaaataagccaatcgtgtttgtgcaacatcacgatgctgacttagtcactggttctgccgattggcagatgataccagagttgccaattgaagcaaccgatattgtggtccagaaaacgcacgccaacgctttttatcacacggatttacaagcccaattgacggcgattggatgtcaaacacttgaaatctgtggtgcgcaagttgagttttgtgtggatacgacggttaaaatggctcatgggttaggctaccacctcgaaatggttcgggggttgacgacaacgacggccaattccatgatgagtgcgcaacaaacgattgatttttatcaagatcggatttggaaccaccgtttcttgacgttggtaacagcatcgggccgtattgacgatttgttagaaaagacgggtgattagttaaaagcattattttttaatgattttggcgatgcgtcggtcctacagtacggtgaggtggcggacccaatcgttactgcaaatactgtattggttaaaacaacgtatatcgggctcaactttgccgacatttatcgtcgtcgtggtacctatcatttggaaaagcatcaaccgtacattgatggttatgaaggcgtgggaacggttgtggcagttggtaagcaagtggcgaattttaaacgcggtgatcgggtgttattcgttgacgtgccgtttgccaacgctagccttgtcgcggttccagctgatcaggcgattaaagtaccacgggcaatcaatgatcagcaggtcgctagcattggattgcagggcatgactgcggagttcttagtccatgacttagcacaaagccaaccgcacgatcgagtcttgattcatggcatcagcggtggtgttgggcagctattaacgcaactgctcgtggccaatgaggtggctgtttatggtgtggcgtcaacaccggcgaaagctgaattggcctatcaagctggcgcaaccaccgtttttatgcgccatgatccttgggacacgacccatcataatttttttgatacggtgtttgatggggtcggtaagacactaccagttagtctggcgactaccaagcaccgtgggcgggtcattttttatggcatggcagctggcaatccaccagtaattgatccagtcaagctaatgtccgaatccaagagtttgatgactggtgatttatgggattatttggacagcgcggctgctcgtcagtgccgtgccaatcaattgtttgatgatgtgctcacgcatcgcgtgacgatacgaccagcgacagtctattcattagcagaaggagccgctgcgcaccgggcccttgagaccgggcaagttgctggcaagattttattgcgcccatgaagtacttgaatcgtatttgaaattaactggtttaatcgaatatcaccaaacggcatcgggcagtttttccgatgccgtttttgtggtggattagtagtgcaggctgaatcgagcgccagttagtcaattcaacaattgaattattaaaattcccagtcatgaccacggactgttacactaagtgctaaatcggtcaaatggaagtgtgatggtcatgattcaattagtacgttattcgacgacacggggagcactgaagcaaatacaacagtatcaactggttaatgtgatgtacacggcgacgccacaacaagttattcgtgcttgcaaatctgatttagaacgaacggccgttatgattatgaatggcaaccaattagtgggctttttctgtttgcatgttggtcaaggaccgctcagttacggtgaaacggaagtgaatacgattttgttgcgagctttatctgttgatgatcgctttaagcatcagcgggttgcgtctgacgcgcttgccgaattaccacgttatcttgccagtcattatccgatgattcaaacaatattattagcggtcaatcatgccaatcatgtggcgcaacatttatacctgacccatggtttcactgatacgcatcgccgcatagatggtcgattggggcgtcaatttatttatgaacgcccagtccattgtcccatggatttaaattttgattgaaatttgcttagttagttcagtcaatctagtatttggaatcttatcggaactaggtgcgatactttagaatcgtttgtgtcgttgcgaatgagattagatttaaacgaaatctgattgaacggctcgttttacgattggctttctgttagattatgataatacgattagaaaaagccgatcgtaaattaagctaatggaagtgatggtaatggtagcaattctttctctaatggttgtcatgggttttatgatgcttggcgagtgggtttccacgcgcagtcgggcctatgttccatccgtatttattacggcactcttatttctagtgggtttttggacaattgttcccaaaaacattgtccctgctgcttcatttggcactgcctttattcaaattacccaagccgttttattggttcatatggggacgttgatggatctgcaattgttgttaaaacagtggcgcgcagttgtgattgccctgagtggcgtggttgggatagtggtgctcacgatgggaattggccgtcttttatttgattggcacacgatcgttgccagtgtgcccccgttgacgggtgggttagtggctgcctttctgatgacagctggactcaaggcccaacatattaccgcacttgtggcgtttccggtggcaatgtttgtcatgcacagcatgctcggttatccgctaaccgcgtggatgctaaaacgggagagtcgccgactattgcaagtccgacatgtagacgtcacggtcgcgaccgctgattctgccaccagtgcgacagttcaaacaacggcgcaattaccagtgggcccgctaccaaccgtaccagcgaaggtgaaatcagttcaacctcaattacggcattggcaactaccggctgcttatgatacttcagcttttatgttatttaaagtcgctgctgtgactgggctagctgaatggactgcccagttagcccatggcacgattaatcagtacatcatttgtttagtgtttggtgttatcgcgcatcagttgggctttttagaagatgcggtgttggagaaagcgggcgtctttcactggctgatgtatggtttgctagcttatatttttgccaatctaaacattgttaaaatcagcatgttaagtggtattttgatcccgattgtaacgttgatcgttcttggtgttttagggatgtggattgcatctagcttattggcgcgaccgttgggatttagccgcgaaatggcttttgcaagtgcattgactgccttatttggtttccccgcggactatatcgtcacccatgaagtgaccgaaattatgggatcgactgcggaggaaaagcaatatttactagaccagatgttacctaaaatgttagtgggcggttttgcaaccgtctcagtggcgtcagtgattattgcgtcaatcttcttgaaaattttatagggggcttttcagatgatgacaacaactttagcagcttggatgacaaccttgcgccatcaattacacgcacacccagagttagcactgcaggaagtcgcgacgaccgctttaattaagcaaacattgactgagttgaacattcggttggtagactatccgggagaaactggggtggtggccgagattgggcatggtgcgccaatcatcgcgttgcgcgcggatattgatgcactcccaatccaagaagacaatgagttatcctttagatcaacgattcctggtcggatgcacgcttgtgggcatgattttcacacggccgccttattagggggagcgcgattattgaaagtgcatgaggcagatctcaatggtacggtgcgactgatctttcagcctgcggaggaaggacaccgcggtgccaaaatgatgattgataatggtgttctagcaggtgttcgtgcgattgcgggattccataatatgccgaatttaccagtcggcactttagcgatgaagtctggaccactcatggctagtaatgataattttgacgtcacaattttgggccagggcgcccatgcagcgatgcccgaagcaagtcatgatcccatcgtgacgcttggtgaattgatcagtaatttacagaccattcgtagccgaaatattgcgccagacgcagcactggtgctaacgattgctgccgtccaagcgggaacgacttttaacgtgattccaaatacggcgaatttacgaggcacgattcggaccttcaacacggctaaccgggatctagctaaagtacgtttttacgatattgtgcgtgcaactgccaagatgaatcagcaaaccgctacaattgattgggaccgaggaccaagctgtgtcaacaataacgcggcacttaccgctgtactatcacgtgttctgaaagatgattttgatattgtgcctgcccagctatgcaatgccgacgatgattttgcgttatatcaagaatgtattccaggattctatggattcttaggttcaggcggcaatgggaccttacatcaatcaaattaccgctgtgatgacgcaggcctaacctatggcgctcgcttccatgaattggcagctacggcactattaaagtgggttcgagcttgaattgaaagtggtcaatcgacaaagggaagacgcccgaccttgctaggaaactaacatggttgggcgcattttttatggaaagcttctgaatgataagtaacaagcgagtctggtcacaattatctgagtaactaaagtatttgttgatacccgacttggtgcaatcattaactgatacgtgcagattattgttataatatatgtgtattagttttaatattattattttaatgatgaagggaacgaccgctgattgaattttggttgaggcggccaaaggtgattaggatgaaatcaacaattttcgaaaaagctggactagtatctgttcaggaagttgacaaaccaacattacaatctgatgatgatgtcattgtgcgcatcgtgcggacttgtgtttgtggttccgatttgtggtcatatgcgcatggtgatgacaaggctgcccattcgatcaacgaaggacatgaagctatcggaatcgttgaggcaattggctcggccattacgacggtcaagccaggcgactttgtcatcaccccatttacccatggctgtggtgagtgcacggcttgtttggctggtttcgatggtacttgtgatcggcatccggaccacacaaattggtctaatggctttcaagcagaatacattcgcttcacttatggtaattgggcgttagttaagattcctggtcaacctagtgactatacggaagggatgctcaagtcattgttgacgctggcagacgtgatgccgactggttatcatgcggcacggtgtgcaaacgttcaaaagggcgataaagtcgtggttattggtgacggtgccgttgggcaatgtgctgtgattgcagctaagttgcggggtgccgcgcaaatcgtcttgatgagtcgccacgaagatcggcagcaaatggcacttgcttctggcgcgaccgcggttgttgctgaacgtggtgacgaaggcattgcgaaggtacgcgaaatccttggtggcggcgcggatgcggcgttggaatgtgtcggcactgaagcggccattgaccaagctttaggtgttttgcataatgggggtcgcgtaggctatgtgggtgtaccacattataataaccggccacttgggtcaacctttgctcaaaatattgcggttgctggtggttccgcctccgttacgacttatgacaaacagttcttactcaaagcagttttggacggtaatattaatccgggccgggtatttacgcaaacgtatccattagccgacattaatcgggcttatcaagacatgcaaaatcgaaagacaattaaggctatgattaccattgattaatctcgactaggtaactagtcgcttaaaagcaatcgattaaaagtcgtttcagtactgattcatcgtgctgaaacgactttttcgatggcgataatttaatggtaaaaatcaatcaagcttagttgatctagactagtctttgcgttggtattagaaaaaagacatgcaaccagttgaaccgtgtcattaaagctagctggtcgcacgattgtagttggcttcgataattaaccgtttaaaagaacgcattttgctgtccgtgctgtcgccagcttgctatactgggtcaaaaatgaggtgagcgtaatgcgagtctttacttggatcgtgcgaacaattgtggctggtgccgttttgatatgtgtcattatgattggtttggcaccgcaaacagttgtcacacattttaatagtgccggcttggctgattcattcggcagccgctggtggctagtgatgttaccactattagttgtggtaacgggtgaagtcatgattaagttagcccgtcaaaaacggcgcaagctcggactcttgcaactgccgacgctaacaggctttgaagggcagtgtttaggtgtcatggtgggtttcagcgtcctgttgtgggttatattgcaaccggaagtgcagtgccggctagttagcgggggcattggcggatggtgattaggatgagaaattggcagcaggatgtttatgaattcgcctgaaattaatttcaagcgaatttttggtggtgtagttattttaaaatgcttagaccatcagggcttgatcaacagcgccaggcgtaatgagtgcgattttgcagttgtctgagttgattaatatcagctgttaatggcctgcgccaaaaaatggcatgttatgttatgatgatgacgtgataaatcattaagccgttgcgattttctatgtaaactattgttattgaaaaacataggaggtcattgagatggcagttattttaattacgggtgcaagcagcggtattgggtttcagacagcgaaagacttagcacagcaaggtcacgttgtttacggtgcggcgcggcggttgaataaacttgaagcactagccccatacggcgttaagcccttgtcactagatataaccaatgagcagtcgcttagtcaggccgtagcaactttaattgccagtgaaggacgcattgatgttttgatcaacaatgcggggtatggctcatatggcgctgtggaggatgtttccattgatgaagccaggcaacagttcgaggttaatttatttgggatggctcggctgacacaattagttttaccgtatatgcgcgcgcaacgtgaaggacgcattatcaatacctcttccatgggtggacggttggtgagttatatgggcgcatggtatcacgcaaccaagtacgctgtcgaagcgtttagtgacgcattacgaatggagactaaagactttggcattaaagttgcaattattgaacctggtgggattaaaaccaactggggattcattgctgcggatcatttagaagcctcagcacgtcacagtgcatatcaaacacaagcgaccaaggctgccgcgggtatgcgccgacaatactcgtcgcgaatgatgtctgatccaaaaattatttctaaagctatttcgaaggcggtcaatcagaaacgaccacgggtgcgttatttaattggatttggggctaaaccgctggtacttgctaaggcgattttaccgactcgtgtttttgattttatcatgatgcatgccagttagtaggagtgattagtgtgaagattatggtttctgaacagtttcagtgttttatggcaagccttggcgttgatttaaatagcctgcttgaagctgccggtattaataaagtggtttggcaagaacaattaatgctttctgatgtggagtattggcagttaatgaacgaattcgacaaccaattgacggatgaaatgattcttagtttagggaatattactaacattaatacgtttatgccgtccttttttgcagcattagctgctaaaaatggtgaacaagcgattgcacgcatggcaaactataaatcattggcaggtccggttcatttagagatagtgaccaagccagatattgtcaatattcatattttgggaaatagtcttggcgtcgagttgccgcgtttcacgattatgacggaacaattgttgttaatcagcttgttacgagtaggtacgggaaaactcatcaagccaatttcagttggtagtaagtatccgtatggtgatcagattgatgccgtgatgggcattcgacctcaacaattggctgataattgcattcagtttcaagtcacggacttacagcgggcgtttatttcggccaataattcaatgtgggcatttttgcaaccagggttagaccaacaaaaactggctattgaacacaaccaatcattgctcgcgactgttcaagcactattgttgaagaaaattcctagtggttccttctcaattgacgagattgcaacaagtttgaatctcagtaaacgaaccttgcagcgtcatcttagtactttaagcaccacatttaatgatgaagtccaaattgcgcgtcgaaccctagtggtacccttgatgaaagatcaatcgctaaacttgattgaaatcagctatttgttagggtattcagacccagagtctttttcgagagcttttaaaaaatggtttcatcagagtccatccgtttaccgccaacaatctctggggatgttcaaaaattaacaggcattgccgtttaggttaaaagttatgggcgttaaaatcttatggatgtgatggctttagactgatgggtaatcctttaaattaatagatcgtcataacaattgtgtttaagaatgctagttcttagatgcaatttttttttgcgtgcatttaagctagtgacagttgaacagattgtatcactgcttgctgaagtcaaaacttgttagcaatttgattataaactttatagtcaaattgctaaactgtgccagttcgttgacggattatgaccgcaaaaaatggatcgtcaagaaattttcgcaaaaaaataaagctcgattagagcccagcttaccgggatttggctactaaaaaatgtaacatactgtaaattaatctgctgaaatcaattgacaagatttggccggacgattaacttaatgccattcccaaacgccgtgaaaggagcgactaactatgagtgtgttagaagcaagtgaaattatgcaattaatccccaaccggtacccaattttattcatggaccgggtggatgaattaaatccgggtgaatcgatcgtggtgacgaaaaatgtcacgatcaatgagtcatttttccaagggcactttcccggtaacccggtcatgccgggcgtgttgattattgaagctttggcgcaagccgcgtcgattctgattttgaaatctgaaaagtttgctggtaagacggcttatcttggcgccattaaggatgccaagttccgcaaaattgtccgtcccggtgatgtcttgaagttgcatgtccaaatggtcaagcaacggtccaacatgggaacggtgagttgtcaggcgatggtcggtgacaaggcagcctgcacaactgatttaacctttatcgttggtgcaactgattcaaaatagaaaggtggtaatggcaattcggcgattgtcgtttgggaaagttttttaaaagcattgccgaattgtaaccaaccatgacaactaatttttcgattttagcgagtgctaaggcactgccgacgaccaaagtcacgaatcaagaactaacgcaactgatggcgacttctgatgattggatcaagcagcgaacgggaattcgttctcgccacgtcgcgaccgatgagacaacgacgagtttagctgtttcagttgcccagcagttgttgcagcaaagtcggctagcggcgacggcgattgatttgatcatcgtggcaaccatgtcaccggattatttgacaccggcgacggctcctcaagtacaggcagcaattggggctgaaaaagcaattgcctttgacatcaatgttgcctgtgcgggctttgtttatgggatgcagttggttcaccaatacttacaaccgggccagaccgctttgttaatcggtagcgagaccttgagtcggttagtagactggcatgatcgtagcactgccgttttatttggtgatggtgcgggtggtctattgattactgctaagcctaatacggccactgggcactggctgggcggtcattacgcgacgtttggcgctgacgggcattatttaacggcgggacagcaacctcaggtgaatccgtggtcgacacggactgatggtgcagattctaaccgctgggcctttcagatgaatggtcggcgggtttatgactttgccactaagcaagtgccgcactcaattgagcaggcgttgatgcaggcacggctcgagtcgagtgatattaaagcatttgtgcttcatcaggccaacgcacgtattgttaagagcgttggtcaaaaattaaacttagctacggaacaattaccgatgaacattgcacagtatggcaatactgcggcagccagtgaaccgattctatttgccgaaatggttgcccaaaagcaagttcaacgtggtgacaagctggtgtttaccggttttggcggcgggttatccgtcggtagtgtcgtaattgagtattaattgataactgaaatcaagcatttaaaattaatttaaaaattctggaggaatcaacaatgactaaaactgaaatttttgaccaaattaaaaagatgatcgtggaacaattagacgtggatgctgacaagattacgatgacaacgaactttaccgaagacttagcacttgatagtctggacgtttttgaagtgatcgataagatcgaagacgaatatgatatcgaaatcgaaacggatgacgctttagccacggttggtgatttagttgattatgtggcgactcatcaggaaaatagcgaggactaagttatgaaaacggcaatcttattcagtggtcaaggacaacagtttgccgatatgggggccgatctttatcaaacgttaccagcgtaccaagccacgattgacgaagctaatcaagtgttggactgggatctgcgggtaactgctgattggatcgatgatgctcaacggatgccggttgcaattacagcgatgaatatggggttatatcgtgctttaacagcgttgcttaatgagtgtccaaccgtgttaacaggattgagccttggcgagtatgccgcattgattgcagctggcgtcctgccatttgctgatggcttgaagttagttgccgatcgggctagatatatgcaacgagcgggattacagcatcccggggagatggtcgcggcgttgaaggtaacgccggcactggttgcagccgcttgtcaaagtgcccaagcagtgggggttgcgtatcccgctaattacaatctagctgatcaaattgttattggtggcgatgcagctggtattcaagctgcgcgaacctatttaaaaacacacggcgttaaacgggtggtcccattagacgttgcggtggcttcacacacgccgttaatggcagcagcgagtgaggcgttggcgcaacgattacgatttgttaatattgcagcaccccaaattccggtcatcagtaatacgaccgtgaccccctttagccaggcaactgtcaaggaaacgttggtaaaacagttagtatcgccaacgcactttgcggcctgcttacaacgaattgcgacatatgaggtcgatgagattattcaagttggaccagggcatagtttagcaacttttgccaaacaaacattgccgggggtaagggtttggtcaattgaagatatgacagattggcagaattattgtcaggatactgaggaggtacgtgagcgtggatgaagtgattttagtcactggagctgctaagggtattggtttggcaacagtcaaacggttggcagctcagggggccagcgttattttaaacgttcatcatgaaattgaagcggccgattggcaagcattaacggctgaatatccaaggttgacgcaattagttggtgatgtgagcgatgatcaaacggcggctgatttaattgagaccgtgatgacaaattttggtcgcttagatggactcgtgaataacgctggtgtgacccatgatcagttattaacgcggctacacgcggaagatttcatgagtgtgattcaaacaaatttattgggcacatttaatatgaccaaatacgctttaaaagtcatgcagcgacagcgacaaggcgccatcgttaatgttgctagtgtggtcgggttacatggcaatatcggccaggcgaactatgcggctagtaaggctggaattattggtttaactaaaacgacggcaaaggaaggggctcggcgccaagtgcggtgtaatgcggtggccccaggaatgattacgacggccatgacggcacaattgaatgaccgtgtaacggcggctgccttaagtgatattccactcaaacgctttgggacgcccgacgaaattgcccaagcaattgactttttattgcaccaaccgtacttaacgggacaagtgctaacagttgacggtggcatgacgatataagatatgggaggttatccaatgacagaacgagtagttgtgactggaatgggtgcggtgacgcccctcggtaatagtgttgatgaatttttaacggggttattcgcgggacaagttgggattaagcccatcacgaagtttgacgcgacgcccactgggattacagttgccggtgaggttaaggattttcagccagaagaacgaattgaaaagaaattagcgaaaagattggatttattttccgtttatggtctatacagtgcaagtgaagcgatggcgcaagccggactaaatgaagcaaatattgatccagaacgattaggcgttatttatggttcgggtatcggtggtttaacgacgattgaagcgcaagtgatcaagatgcacgacaagagtcccaaacgagtttcaccgttattcgtccctaattcaatcatcaacatggttgttggtaatatcgcgatgcaatttaacgcacagaataccagtcaagcgattgtgaccgcgtgtgcgtcggcgacgaatgccatcggcgatgcgtttgaatatttgcgtcaaggaaaggcagatgtgatcatcacgggtggttcagaagcttccgtcaacgaaatcggtattgcagggtttgcgtccctgactgcgttgtcgaaagccactgacccaacgttggcttcattaccgtttgatcgtcaacgcaatgggtttgtgatgggtgaagggggtgcgacgttagtcttagaaacgttggcccatgcccaagcccgaggcgcccagattcttggtgaagtcgtgggttacggaacgactagcgatgcttatcatatgacagccccccgaccggatggtgctggtgccaaacgtgcaatgcaacaagccgttgcggaagccggcattcagccgcgtgatgtggattacatcaatgctcatggaacagccacacctgcgaatgatagtgccgaagctcaagcaattagcgcgttgtttggtcaagatatacaagtcagcagtactaaaggaatgacggggcacttattaggcgctgcgggtgcaattgaagctgttgcaacgattggtgctctgcaagcgggtcagttacctgcgaatattggttgtacggaccaagatcctgagtgtccagtcaatttagtaacgccagcaactcaacatcaagccgcaacctatgctttgagtaattcatttggttttgggggccataatgccgtggttgcctttaagaagtgggtgaatgtatgagtatgacggatacggaagcgatgaccgccctgatcaatcagtttaatcaatccagcgctcaagtcatggacgtcaagacgacaacctttgaactgcatttgaataaacaagctgaaactgctgagacaaattcagcgcgttcacagccggcagtgaccgactctacggtaccagtggtcaaaccgacgactgaagtggcgactcaatcgggaacaacgatggtcacggcgcccctagttggggtggcttacttagctgccgacccgaaacaggcgccgtttgttcaggtgggtgatcgtgtcaagtcaggggaaaccttgtgtgtaatcgaagcgatgaaaatgatcaacgaagtccctagcccagttagtgggatcgttaaagaagttttaattaagaatgcaactatggttgaatttgatgaaccattgtttgcaattgaggagacgaccgtttaatggaagttacggatttaattccccaacggtttccgctgcaattattagaccgtatcatagcggtccaaccaggtgtcagcgcaacagcggaaaaattagtcacgattaatgaatggttttttcagagtccgacactgaccggaagaacgatgattcggccagtattattagaaattttggctcaaacgggagttgtggctttactatcgatgccggagcatcatggtaataacgtcttttttggcggaattcggcaggctgattttaagacggatgtgcgcccaggtgaccggttagaagcgatggtaacgttaactaagttgcgtcgtcaaatcggaacaggccatggcgtgattacctgtgctggtcgtgaggttgttagtgctgatttaacctttgtaatgcaagcctgaaggaggtatggcgattgtttaaaaaagtcttagtcgcgaaccgtggtgaaattgcggtccaagttattcgcgcgcttcatgagatggggattaaagcggtcgctgtctattcagtggctgatcaggagagcttatttgtacatctggctgatgaggcggtctgtattggggcgagtcccgtcaaccagtcatatttgaatatgcaagcaattattagcgctgctaatttgaccgggtgtcaggcgattcatccaggctacggctttttatctgagaatgcggaatttgcaaaaatgtgtgcggattgtcagttaacgtttattggaccgcgtcctgaggtgattgaccagatgggtgacaaagaaaatgcccggcagaccatgcaacgattaggcgtacccgtgattcccggcagtccatcggtgcttaaggatgttgaggcggctatgcaagctgcccataccttaggttacccagttatgatcaaagccgctgctgggggtggcggtaaagggattcgcgctgttagcaatgatcaagatttagcgaaggcctttcgaacagctcagcaggaagctcaagcttcatacgatgatcatcggttgtacttagaaaaaatcattgccccggcgaagcatatcgaagtgcaggtcttagccgatcaacaggggcatgttatttatctaccagagcgcgattgttcgctacaacggaatcatcaaaaagtgttagaggaaagtccatgtgcggtcatcacgactgctgaacggaccaaattgggacaatcagtggctaacgcaaccaaaaagttgggttatacaaatacgggtacctatgagtttttaatggatcagcagcatcatttttattttttggaaatgaatacgcggttgcaagttgaacatacggttactgaaatggtaacgggtattgaattgattaaagcgcaagtacaaattgcagctggtataccattaaaaattaaacaggcggatgtgaaaattcatggtgttgccatggagtgtcgcttgaatgcggaggatccgtaccacgattttcgaccgcaacctggaaaaatcacccggttgatctacccaatggggacactgggagtccggattgatgctggtgtggtgactggtagcatgattgcaccgttttacgactcgatgattgcaaaaatcattgttcacggtattaatcggaagatggtcagtcgcaagatgcatcgttgtttattggaattgaccatcgatggggttcaaacgaaccggaccttcttagcaggattagttgcagattcgactgttagccgtggtacctataccacagcttatatcgaacaagactttttgaaaggatggttaagtgatgcccaagcgcaagtttcaagcacccactgaacggcagttagctgttcgacgggataatatcccagacgcgttattgacgcgctgtccagtttgtcatgaagattgttatacccaagatctcggtgaattcaaggtatgtccccattgtgattatgggtttcgcttgcctgcttggcaacgtgttcaacaattgacggcgagttttgaagagcgggatgcggacctaagtgcgcccgtcagttttgatgaccctgcatatttagaaaagttgcagcgtgccaaagcagcctcacacttgaatgagagcgtattgactggtattgggacgttagcgacttatcaatttggcttaggtgtcatggaaactaaatttatgatggggagtttgggggcggcaaccggtgagaaaattacgcgattatttgaaacttgtacgacccaaaaacttcccgttgtgatggttactgcttctggcggggcgcgtatgcaagaaggcgctcgtgcattgatgcaaatggctaaggtgtccacggcggttgcaaatcaccgaaaagctggactgttgtatattacaattttaactgatccaaccactggtggtgtcacggctagttttgcgatgcagggtgacattatgttgagcgagccacgagcgctcattggattcgcgggtcggcgagtcattgaacaaaccattcaacagacaccacctgcggattttcaacgggcggaaaccttattagccaatggatggttagatcaaattgtaccccgaccagccttacggaaaacactacaacgattattaacaatcactcagggaggtcatcaggatgtctaaagtaacggcctatgaacaagttcaagcagcccgtgatgctagtaagattagcattcaaacgttgattgatggcttgacagaggatttttttgattgtcatggtgatcgtcaacgggcggatgatccagctgtaatcgccggcttagcaacaattgctcaacggcccgtcaccattattggtattcagaagggtcaaaatttggccgagaatcaagctcggcattttggctgtgcgacgcctagcggttatcgaaaagcattgcggttaatgcggcaagcagaacaattacggcagccggtcgtgaccttaatcaacacgccgggtgcctatccgggtgttgatgcggaatatgagggacaaggacgagcaattgctgactgtttgttagcaggattacaattgcgagtaccatttttgagtttgattgttggtgaaggtggcagtggtggtgcattagccttagcatgtggtgatcaagtctggatgttggcgaatagtacttactcggtgttatcacctgaaggctatgccactattttatggaaagaatcgcaacgtgctgctgaagctgcggaaaaaatgcgcttgacgccgacagaattattggcagatgggattatcgatcggattattcctgaagtagcaaccgcagcagattgtcaaccgctgaaaacagccattgacgagacgttaactgctttaacagcaaagtcggtggcggaactggttacgcaacgccaagcccgttatcggcaattttaaataagtgaggaatgataagtatggatggaattttatcgggtaagaccattgtggtcatgggtgtggccaatcagcgcagtattgcctgggggtgtaccgaggcattaattgcacagggggcccaggttatcttgacttaccaaaatgaccgtttgaagcaaagcttacaacggtttgttgcgccagatgtgccgttaattgcctgtgatgttgctgatgatgacaatgttgagcgggcatttgcaagcattaaacaacagtatggtgccatcgatgggattatccatgcgattgcttatgcggataaagcaaccttagaaggtgattttgtgaataccacgaaagctggatatgatttggcacaaaatattagtgcgtattcgctgattgcagttgcccgagcagctcggccaatgctgaaaccaggagccagtctcgtaacgttgacgtattttggatcagagcgagccgtaccaaattataatatgatgggggttgctaaggccgcgttggaagcaaatgtgcgttacttggcacgtgaccttggaccacaacaagtccgcgtgaatgcaatttcagccggagcagtcaaaacgttggcggtaacgggtattcatgagcatcagcaattattaaaattatctcgcagtatgacagttgatggagaaccggtaaaaacgcgtgagatcggcaacgtggctgcctttttattaagcaatctatcgactggaatgaccggggacgtggtatacgtggataaaggggtccacttaagttaatgccaatcactcaagttgtctttaaacggcagtggcttcagatgccggtcgatgtttctaaaaaaatgcggcgggtcactcagcgaaccgtgagtcgccaattaattcagcaagtgttatcggtaccattagcttatcatcgattgggccagccgtattttccaagtcatcctcgattaggtgttagtgttagtcacacgcaccagttagtgatggtggcggtcggtccgggacctttggggatcgatgttgaacaggtccgtccatatgatgtaactgccattcggcgagcctttacatcggcggaatggcagctattacaggctttatcggtgcaagatcgttatcggttagggtggcaactttggacggctaaagaagcggtattaaagttagtgggctgcggcttgacccatgcgccccgccgtgtcgaggttcttgatttacaacgtggactagcgtgctatcaaacacagttataccagttgacgccgttagaattgcctgcgacccacgagggatttttggctcgtcccttgtcggttggctgattggagcgcatggttggtattaactttagtacgctcttttttaagtttagtgaacaatggccactggattttattatcggccaactggttgacctgctagtgcaagccttctacgtgctgactaaaagcagttctgagcaagccataattgtgggctcagaactgctttttaatttatccttcaataatttatctataataatggcaatgcaaaattcatccataaccatgaaatcggcatgataacgaccatcatcggaatcatatcggcggtcggaaacatcttgacggcaataatgcgaaagccgctggcaaccattaaaataccaccgaccgctttgaaatctagaatcatgtcaggagtggtcaagggaaagactaggtgagcgactaagaataaagcagtcaggatgattagttggggaacagcaattaaggaaacaactaaccctaagttagcaccgaaaattaccgcagcaaagaagtccagaattgatttggaaatcaaaattgtggcgtcgccgttcatcccttcagttaaagtcccataaataccagttccactggcacaaaataatacgattaccgtgaccattgtctgttcaaaggcctgtttctcaaaagttgctggtgctttgacaaaccgtgaaatgaaacgttgcatcgcggcagcgccgtgattgattgcagttcccaaatggcaaagcaatccaatacctgttccgataataacggcaaagatgaccgccgctagattttttaatggtgcaatcgcgtaaatccccatacacatggaacagatcccaaaggacatattcagcccatcttttaaacgttgtgacattcgtttgccggtcaatgcgcccacaatacccccgaaaaagatcgcacacacgttagtaataattccaattggcacgcaagccctcctcaatatttaattgataaaaacaacagctattagtttagagcttgtttcggataagaacaattctgaatatgtggtaaactattctaaataggaatagttagaagagggttaattatggaaacacggaaattggcagtgtttgttgaccttgccacgacccagaactatagtcgcagtgctgaacgcatgtttttgtcacagtcgaccatttcaaaatacattatggctttagagcgcgattggcaggtccaattatttgaacgtgcgcatcggcaagtcacgttaacacgggttgggcaacaattattgccacgggcccaagcaattctgcgcgaagagcgtcagctacaacaagttctggccgctaataccgctcataatgcgcagtcgctggttgttcagggactaccatctttagcacaataccaggcttttcatattatcacggcatttacgaagcggtatccggaagtgaaattacaatttagtgaggcgagtgtcgatcggttagcgcatgcactggatcatacgaatgtcgacattgtatttacacggattttcggggatcaacccaataattatgacgttttattgaatgagaccgatcagtttgtggtccttgttccgaaagacgatccgttggcgcaacaagctgagattagtctgtcgatgctggcacatgaatcaattttattattgaaagataccatcggtgaagataacccgttgttttcggcatttcaaaaaatgcatacgccacagatggtttatgatggtcaacgaattgatctcattttagaaatgctgaatcagggtgatggtgtctcggttgtcatggcgcggtcatttgatctcactggttttgacaacattaaagccattccactgacgcctactattcgcagtcagatggctttcatgaagcgtccagataatcacgctgccgtggttgctaaattttgggcgtttgcgacgaagtatagccaatcactttcagattaattgtggcggctgatcacattctaacgatgtgtcttgaatcggaatcaaagccgacgatgacataaggataaaagcagtcggtttcggtggtcgtagcaggaaggacgtgtccgaacaacaatcgagctagctagtctgttttaatcacattgtaggtcgtttgcagtgatataaataaaataattaaagatgacggggtgcagacatggaaccaattcatatttcacagactttatcaattagcaatcaccgtgtgttttcagctgatttgaatgagcacgacacggttttcggcggaaaaatcttggcgactatcgatgataattcatcgattgccgcatcgcgagtggctcgaattgagacggtgaccgtgtcagtcgatcaggtcaattttttattgccgtttcggttacaagactcaatgtgtgcggaatcttacgtttcgggcgttggtcaccgctccatcgaggtatttactaaaatcattggtgaacacttgaagaccggcgaacggtttttgggattgacctgcttttcaacgttcgtggtgacggaccgtaatattgaattaccactgttagtcgctgataaaccagaatacacgtttgttgctcagggctatcaagagcggcaggccgcccggttagccaaactaaagcgccagcaagactttaatgcgcacattagcgttgaattgccgtggtgaatcgctttaaattgacaattttggtgagacttgttaaattgtaattatcaaatataggaggggtgttttatgtcgggcattcgttagggtgttgttgagcgaaaaaagtgggttggacccgcttagtttcgtgtaccctaatgtgacgaatagcctggcagatagacatgtcggacggtttttgcgcacagttgggataagactgggcgcatttttaattcgcagagcgttagggtaagtcactttgcgaaaggattataaaaattgacaattaatttaattaaatatggattgacgacggcggttcaagccgacttgactaaggaaaacggtcaaatacttggccggattatcggccaacatcgtgattggtaccaagtcatcacgacggctggggaacgttcagcacaagttacgggaaaactggcttatgaagcggccagtcccgcggcatttccggcggttggggattgggtgtgcctatcttcatccgctgataatcaggcgcagattgaagcaatcgcgccacggcagagtgtcttggcgcgcggtgccgtgaaccgccaagacggccaaatcattgcgacaaatattaataccatctttatctgcatgtcattgaacgcggattttaatgtgcggcggttagaacgttacctgacgattgcgtgggatagcggtgcacttccggtcattgtcttaaccaaggcggatctctgtacggatctagccactaagttacgggctgtggcggatgtcagtgtcggcgtaccgacgatcacttgttcggtcgaaacgggtcagggtttggatgaattgcaaccatacctaacgactggtcaaacggtggccttcgtgggctcttcgggtgtcggtaagtcgactttgattaaccgattgttgggccaggatatcttggcgacgaaatcgattcgtacagatgatgacaaagggcggcacacaacgacgagtcggcaattaataccgctaccaacgggcgcctgtgtcattgatacaccaggaatgcgtgagttacaaatcttcatgggtgatttaaatcaaactttcgcggaaattgcctcattggcgacacagtgtaagtttagtgattgtacccatactagcgagcctggttgtgcggtacgggcagcagttgaggtgggcacggtaacgtctgaacggttacaaagctatcaaaaattacaacgtgaaatgagctatcaaggactcaattcacgccagttggagcaggctaaaattcagcggatgttcggtggcaaacaagcgatgaagcgtgttaaacaacgttaccatcgcgactgagttgataagtaaattaaagaagctactaaacgggatgtcggcaacggcaccccgttttatttaggacctactttcgttatcgcgtagagtgaaccgagtgacctgttgagcgagataggccggtgtttcaaccatcccattctgttgccaatgaacgagcatattgatgaccgcaccagaaaaataagccgtgtagtacggttggcgaagcgcggtattgcttgaaccgataatacggtcttgtttgatgagtaatgcaaagacggcttcgaaactttgaataaaaatctgggttttttcatttttgatcaataacgcatttgtcgctgccatttgttgcatgagagtgaaatattgagtcatcaatacctgcaatttaacctttgattgtcgcagtaattggcgcagatattgaaggatagtctgtttttgataggccaaaataatctgatcgaagttggtgaaattacggtaaaaataggtgcgagaaacctgagcgtgctgacaaagttctgtgattgaaatacgactgagtggtttttgcgacataagctgtagtaaggccgcataaaccgcagttaaattttggcgttttcgtgtttgtgggttcattggttacaacatctccttttttgtaacgtaagtatttatttatgaccattttaccagatatactcccattaacttaacgggaggcgattatgatgaaaaaatcgacgaaagtaattgcaatgatgatgattggcatttttctatgtatgcttgatacgacggttatgaatattgcgttgccagcaattcagacgggactaaatactgatttgacgcacctgtcgtgggcactgaatatttacaccgtcctgtttgctagtctggcgattccactcggtcggttagcggatgtctggggacgtgggcggatgtacttgattggactcgggctctttggtattggttcactaacttctggattgagtctcagtgtcgggctgctgattactggccgagcgattcaaagtattggtgcggccatcgtcttcccggctagtatgacgattggtattcagagtgttgcactcagcaggcatacgggggtcattgcaagcttgggcgtgatgcaagggctagccgcagcgttaggaccaaccattggtggtgcggtcactcaattttgggggtggcggggaattttcctgattaacgtgcctttagttgccgtcgcgttgtgtggttgcatcgcctggctatcatggcggcaccctagtcatggtcaagtaaaactagacctcggtgggagtgccttagtgatgacgaccttattggcattgacgttggtcctggttaaaggtaatgactggggatggacgagtcgcgtagtcctgagcctgggcgtcactagtgcgctaacattgattgcctttgtctggatggaggcccacgtctcagcgccgatggtcccattagccctatttaaagaccgacagtttaacggtgcggcgttagcgaccgtgttatcaggggtctttatggtgggactattagtcttgatgccgagtttcttcacgaaagttcaaagtaagacggaattgatggcggcgattatgattacgcccgcttcaatgatgatttttattttttcaccaatcagtggtttcttgttagcaaagcttggtgcgcggcgcgtgatctttagtggtagtctcgcaatagctacgggttatggggtacttagcctgatgagtcctagtcagtactggcagtttgcattggcggcgttactggttggtgcgggctacggcacgattattgggccaattacggtattagcggccggtgattttaccggtgagttactgacagcgtcacaaagtgtgattggcgtgtttcggcaaattggcacatcgttggccgtagccatttttgtgtcagctttagccgctaatttgacaacggctaagacacagatacgaacgtatgcaacgacgacggtcactactttatcaattcctaagcaagccaaacgtgatacgttacgcgtggttgaccaccaattagcaactgagcaaaccgcgcaaacggtccacgagccaatcacggcggctaaggcccgccggttggttgctgccaattatatgcaagtgttaaaagcacggtcattgcagtccgctccagtgcgtatcaaagctcaaattcatcagcaggtggcccaaaaggttcacagtcaagttaaacacactaaccagcgaataaggactgctgcatcagcgattaaggccaaagccaaaattgagttaactgctgcgtttatgcgcccctaccaagtcgcttggccattcacgctattgctagtgatgacgacctggtgttttgcgggacgggagcggaaaagtggcaagccgagttaagtcacgttgatggggatggacttcacgcacgtttgaatagttgagccggtagggccgcgaaggcgatcgccattactgactttggaacttgccatcgaacttagctttgcgagcatgtgagacgcttatgctataataagggccaaagggggtagtcttgatgaaagaaaaacaagtgtttcatatcaatggctatattggtctagtgttagcgatcgcatttgtgttagttggcggttggctggtttgggccggtgcgactggcgatcattttgcgagtatctttttgggcgcattgctaattattattgcggcctttggggctagttcgctaacaattgtgggccccaacgaggcgcgcgtgttaacattttttggtaagtatatcgggacaattcgtgattcagggctgtttatgaccgttccgttaaccagtaagttttccatttcactgcgggtccgcaattttaacagtgccattttaaaagttaatgacctccggggaaatcccgtggaaattgcggccgttatcgtgtttaaagttgttgataccagtatggcactctttgcagtggatgattatgaacaatttgttgagattcaaagtgaatcagcggtgcggcacgtggcctctgaatatccatatgatacgtttgatgacgacaagaagattacgctgcggagtaatccaaccgaagtttctgaccggttaacggaagaacttcaagaacggctaaatgttgcgggggtcgagatcgttgagacacgcttaacgcatctcgcatacgcgactgaaatcgccagtgcgatgttacaacgccaacaatcttcggcaattctatctgctcgcaaggtcattgtggaaggggccgtttcaattacggaagacacgatcgcccgtttagagaaagatacggggatgcagctatcagacgataagaaactgcaactgatcaataacatgatggtcaccattatttcggagcggggtactcagccgattgtgaatacttcggaagttaagtaggaacgttgatataacaacaatcaaagttgtagcagtaacataaaaggcgctcatttgctgagcgccttttatactacagttaagtttaaacagtaacaaaaattgacatcatgacccgctaatcttttaaaaagatgctcttttggggatgcctgcaatgggtcaaatcgtagctggaacactctttatgaattgctaggtttactttccaataccgctcatggcaattaggccataccaaccgtgggcaaacattttatttgtagaagttgttaagttggcaattaactgatcttgttcagatgagaaatggtattttttagcgacagccatcacttgaagttgaccgattaattcattgattgcgtcgggtatttgttgataacgcttagtaactgaatctggttggttgatagttgcgtaggcttggctaattaattttctgatttcaactttttcaattggaactgaagtgtttagctgttctaaaagctgattaacagttgttaaacgcgctaatttctgttgctgtttcatcattgaatcccccagtgtagtgtttagtttaaacaaatgaattagttatagtgatataaatttcacgtcaccactatataggctaacatacaaatgaatactgtactgcatcagcaatttagtttttatgttaatttagttgtccgtttagataggctttgccaataataataattaaccctattatgattaataataaactaacataattaagtggccgacttttgctctgatagtgagtgaaccagccatacttgatccgggtgttaaagacattgatgatgaggccaatgccagtgatgaggccgccaattgcgataatgaaatccatttgtaatacctccatttagtttaagcaatttagatgtaatgactgcagtaaatattgatgctgaacaatctcgatgtttggcaacagacactagttcttggtatttaaaaaaataggtcattctgaatttaacatcagtagtttaagattatcaatataaatattatgaacagcataattttcagtataaataaaactggcagtcattgctattattagaaataccgttggctgttcaatacaggttcagtgaaataaagacaatcaatctttcagaaaatcaaattcaggtatataatgtttcatacacaaaacattatataggagactgttatgttagacaaaatcatttataaaaacttatttagtaaagcgttcgatgttactattgaagtcacttattgggatgggcaaattgaacggtatggtaccggcataccagctgttaaagttcgattaaataaagaaatcccaattaagttattaactaatcagccaacattggttttaggtgaagcatacatgaatggggatattgaagtagatgggagcattcaggaactaattgcctctgcttaccgccaaaaagacagttttttgacacataattcatttttgaaacacttaccaaaaatatcacattccgaaaaaagcagcacaaaagatattcaaagtcattatgatatcggcaatgatttttataaactatggttagatggtaccatgacctactcctgtgcgtactttgaacatgacgatgatactttaaaacaggcacaactcaataaagtgagacatattttaaataagctggcaacccagcctggtaaaagattattggatgttgggagtggttggggaacattattatttatggccgcggatgagtttgggttagatgcaacgggtattactttaagtcaagaacaatatgattatacacaagcgcaaatcaagcaacgtcatttggaggaaaaagtgcatgtgcagttaaaggactatcgagaagtcactggccaatttgattatgtcacctcggtaggtatgtttgaacatgttggtaaagaaaatctagggttgtactttaataaaattcaagcgttcttagttccaggaggccgagctttaattcatggcattacaggtcaacatgaaggtgccggcgttgatccatttattaaccaatatattttcccagggggctatatcccaaatgttgctgagaatctcaaacatattatggctgctaagttacaattttcagacattgagcccttgcggcgccattaccaaaagacgttagaaatctggtatcacaattatcagcaagtcgaacaacaggtcgtcaaaagttatggtgaacgatttgatcgcatgtggcaattatatttacaggcatgtgcagctgcttttgaggccggaaatatcgatgttattcaatatctattagtgaaagcgccgagtggaactggccttccaatgactcgccattatatttatgattgatcttgtcggttctgcggtagtcgtatcgaaatatagatccacaataaacatgtagtttcattgatctgttatgatccctttatggttgtcagatgaaatgatataattcatctgatatttcatggagggattttcgtatgccaagatctagatattcagcagttgaaaagttagctctaattactgagttccagaacgctaaccgttgtcaggtccgtcagaagaaacgttcacgtatccagcaacaggaacagtatttacaagacaatgttttagaccaacagtttaacgctagtcggccaaatcaggcctggttggccgattcgactgaattggtctatggagtcaatggccaatacaaagtgcgtctaagtggcgtgctggatctttatggtcggcatttaattgcccataggttaagtgagactgaaacttcaaatgcggagattcaggtttttcaatgagcctttaatttcgcgggtgatgtccatcccttagtgcatactgatcggggctcagcgtacacttcgagcgcatttaatcagtttttggcacagcatgaagttacacgcagtatgtcacggccaggaacgccatatgataacgcaccaatggaacgttggtggaatgaatttaaggtacgctggatagcgcggcacgccagaccagccacctataaggagctggtcgctttagtcgaagaaggtatcacctattttaatcaattagaccgttcaccagcaagaaacgacctcacaccagcagaatattggaataaggccgtttgaagtgaatcaaaacttatattatttcaaatgacaacttgacagggactagtacatcccttataagaacacgagggattttttattatgcatttggaatgattgacaaggagggcaaccattccagacttgttcagtattaggctggaatcgataagcatagaaaagatttcggatctctgtgcatcttggtggctatcatgttttcagggcgttatagtgacaattgaggaggggatcttatgttgagcaccaagaagaatcatgtattacggtacttatttattatagttggtatgatgatcgcgtttttaggttgtggcgtgattcaagtttcagcacatggctttgtgacgaacccgggtggaagagcttatctggggagtacttggtatccaggtgggcctttgaataccaatattggttcggttatgtatgaaccacagagtattgaagcgccccaaaatacatttattgatggcaaaattgccagtgccggtattgctaactttgcaccactggacgagcaaaatgccaaacggtggtataagacacctgtgaaggccggcaatcttagtgtgacttggcagttaactgctcgtcataaaactagtacttgggattactatattaccaagcctggctggaatccaaacgcaccacttaagtttagtgatttcaagaagatagctagttataatgacaatggtgccatccctagtgaatttgtaacccaccaagtcaatatttctgctaatgaaaaaggctatcaagtgttactcagtgtttggaatatagcggatactggtaatgcgttctatcaagtctcagatattgacgtacagtaattagatgaggtctaaatttactttgaggtgattttagactataaaagttgtctttgagatatcgtaaaggtcttactggcgtttattggctagtaagacctttttaaatgtgctttaaggattcatagaagcgaatagcgatgaccggtctttactgattagtgaagtacaggttgctattgtaaattagtggtaataattaagcggatgccgggaatcggatttgcgattacagcttggcagctggcattttagcattaaggggtacgcgcatgagcatcctctcaatgcaagttagctgaacaaaggtggctcaaatttgtgattcaataggtgactgtcagttgcgctcatgtgactacagtaccaagtcgctagtgatccatccgggtaatttcaggctcagttatcagatactcgttgatatgggcgagaaagttttgaaagtgcggcgtttcattgtgaaaattaacggcggcttggtcttgccagtgctcaataatctcgtagtcactgttatgatccagttgcttgaagtggccgtagaaaccgttgccgggttcttgtgaagaattgaccactagttcatgaataaaggcttcatattgagtggttaactcgggtttgacgtgtagtgcgacattaatgactttcattgaatactccccctgttgttcgtgcttgtagactgaccgccactcggtggtgaactttaaaattgcaaaattcgttaagtgactaaaggtcaccaccatactacggtaatcatacaaaaagaatattctgattatatcgtacgagaccaggattgtacaatgaaaacaggtatcaattatgcaactgcatctgattaattactcatttatcaaggccgattggtgcgggcgaaaatttaaacgaattaggcggtatatcggggtatcagtgacctgtacgattatcattttttagtaataataaccagcagatgtatatttatggatttgtcattcaagacgcggtatattaacaatgttaaatactaattcctagggggtggacaataatgagtaaagtttatacggatgtgttcaacatcaagcatacggattgtacggtagtcgataccattaacgaatttagtcgaatttttattatccaggataaacacggctcacggtttacgtgtctcaaagatgatgcccgcccagctaaaaagggtagtggccattggacgagtgccagtccggaagatgcgccacaagattacgctgtgccgtatcgttcaagaaaacggcaacgtagaacgctttaaatagttgattggtaatcagtgccgatacacggggccctggcggtgacaacaccagttaagccgcgttaaaactttaatacaataagataacggtcccatcagtaacaatgactgatgggaccgttatttgatttgcgattatatttaatttaataatgcgacgcctaatgtcaaataagttgcaaaacagatccagaccaagtaggggaccatcaaaattgcggctagccgactactgcgatagaactgtaatatgcaaagtaagacgactaaatcaagcacaatgataatgactaagccccaccaataagccgactggctgaaaaagatgatgctccaaataaagtttagtaacagctggataccaaacagggtggcgtccatgaggcggtcacggtgtgtcgtagcctgctggaaaactaagtaaccagcaatcgcaatcagcgcatataggatcggccaaacgatgccaaagaggccatctggtggtgatagtactggcaagttgagcccattgtaaacggccttaatgtctcccgcgagccatgccgacagactaccgattgcttcgacgaccacaatgaaaatgagcagatgaagccaattgaatttagggcgctctttgatcattgatttttccttccttctattagtcgtctaatcagggtcgtcaattgtgttaatgactgtcacgttgacttccgctttttgtacgacgtacgcggttgttgagcctagcaaaattcgagaaaccgcattggtgccggatttgcccatgacgattagatcaattgcatgttttttgggaatatcagttgcaatgctagcttttggtgaactattaacttgaattggtagggattcgacttgtgctgccgaagccatttgctgaccacgatccagaatgtcctgactattatcttttgcgacttttagaaggtttgtatatagcgttcccccgtaagctgcaggactatacgcattcaggcgtgtaatatcaataacattgaccagaaataatttagatttaaacgtctgggctagtttgaccgcgtgttttaaagccatgtaggcattatcagagccatcaagcgggactagaatattttgatacatcctcaggacctcctaaatgaaatgatgttatttattatattaatgataacattcacataattagtgcgtctattaatatgattaactgccaacgctcagtcacaaaaggcgcaaccattatgggccgcttagccaataaaagttgcgcctagttaaattattgccaacgatttgagcgtgacggcaacaccattaagatgaagaaccaaatggtcccaattattggaactaagtcaattaaaatccaccatgcagtgtgatcactgtcatgcaatcgccgaaacttcaacgagagtgttcctaaccaaatgattaatgcgatgagtttactcatcgtattaacactcagatcgctccaattgtaaatatcctcgatggggtgtcccataatcatctgaataattgcaatgataataccaccaagaatgtagttaatgataacgggccaccagtactcagagcgtgttgctgtacccgaaaagtttaaaagattgtcccaaaatttgcgataagcagatgccatcgtaatccccccaataaagttatgatgtgaacattattattttttccctgtgttaattgggattaattaataactatgtttaactataatcaaaaagttaatagtacgcaatcaatatgttgattatattaataaaaaatacgtcgttattcgatgactgctggtacgatcaattcgaagcggtccgtcaaataggtcaattcaattggtagtttaaccgctgggtcgccgtcaatacgtgtcgtcacggcttgaccagttgcactcgtaattcgtgcactggttgccgttagctgtgtaatggccttggagttttgcaagttccccgttagtgcgaaccaaaaatatggaattacttgccgccagccaatgttgttaagtagactaatatgcatttttcctggagcagacgcgctatagacgtgtccaccgactgatttggtcgttgtaatcaaacagaaccatgtttttaaggtgtggcttccttcgtgtttgaattgatatcgaattggcagtgacttattgtgaccaatatggcgaatagcacggtaaagatagcttaatttaccgaatcgctgcttctcagattgtcgaacttcattggaaatgtcagccaaattaccgaatgtcagtgaactcacgactgcccggcgttgattacaaactagcatgccgactgcttgggttgccggctgagtacaaattagttcgatggccgcttgggggtcagttggtaactggtagcgggttgcaaaattattaaccgttcccatgggaataacgccgatacgaatatgtgcttcagcttggattagggctgtcattgcaacgttcagtgtgccatctccaccaacaataattagtgctgacagttgaggaagcgtttgcttaattaacgcaattgcccgggggattcctggtgttgtcagtaattgagactcaatgccgtggttcgatagcgcttgcgcggtttgatgggcgacggttgccgcttgcccattacccgcttgtccgttacagaaaatgccgtaagttgttgccatgacaatcacctcttgattaaaaaattaagtttattcatcgcttatttagtaagcttttgatagtctcagtatagcttgaacactagtttgactggaaatgatatgcatcattactgaattagtcgggtcaatgagcattttgattgctcaatataaatattatagttatgataattttaatcacacaatatcgggatggagtgtgttcacaatgggatggataggtgttgcgatattaggactaacaataggtatcgttgcaaatgcggtaggcgcacatggtcggcgtcaaacgacaattaatttaatcgcaggcttattcggtgcacttgttggccagctgtcttttggatggttcgggccaacagttgctggaatgacgttgttgccagtcgtgagcggggcgatgatacttattgtgatcggaaccgttgctgcccaggcgcttcagccgcagtaattgtgattaggcataaaaggatttgttgaagtagcacttgttagcgttatcaaaagatggaggtgtccgtaatggctaaaattaaacgacagacccctggtttttggggtaaattgtcactattgattgcaattgggcaattaggattgactgtgtttcgagaagtgcggcagttcaaacaccgccgctaaaaaggggatgacagcatgcattggttatgggtaatgattgttggcgcggcggttggtgcttttgcaggtgctatcatgagccccagtcaatcgcggggttggatcggtcacattattgctggcgttcttggggcactcattggtgaaggtgtgctggggccgatggggcctgagttagccggaatgactgtgataccagccgcaatcggtgcaattgccgtcgttctgataatgatgttcgtggttcagtgggcacgggttcgacggtcaaaacacaattgaacagtgccaattgacagcctggctgttacgctcggcatcaaaaaatgttaaacatcaccctaaacagccccacaggtgacttcgaggtactagcttactcgaagttgtttttgtgtgcgccgatgggggctctcatttgaagtggcgtaatcataaaaaaacggatggtgattttgatcaccatccgtttgcgccgtgcccacgacaaattttaatcgtcagatttcttcttcattttatccttagcttcatccacgacgcccttaacagtttcttctgcgtcagctaatttgtccttagctttgcccattaaggattgtgttttgccctgggcttcacgtgcacggtccccggttactttaccttcgacttctttggccttgccgctcaactggtccttcttgctatcgaacttcttgttaacatcactcataaaaagcgcctcctaatataagaattaaccttagtttgcgataagtgatgacaaaacgcaaccaatatgcacaatgctcataaccactcggtcagaaaggcaatcagtagggcagcaaagttgatcagccaaatttgttgtcgctgggggagcatgattgtcggatgatgtgtcaaaacgatcgtgttcaacaaaaccattaaaataatcagggcgctgagcccgtaatttgtagcgatcaacagatggtcgctggcaatgccggcccaatgagtcagggcaaaaatcaagtttaaaaaacacgcaattaggatactatggcgtagatactttaacgtggtcatcaatggtaacctcccttagaaataatcatgctgatggtttctaagaaaaaatacaccattgccaggttaacggcgtgcaccgagttttatttggatagtaacggaactaagcgcattttgaccagtccgaaagccgcgccacatcaataatggttgccctcaaaaacggatagggggtgtgatttataggtttaaatcagtatcgtaattcaacggtgacatatcggtgcttttagtaatcaggtcagcggcgagagcttgcattgtgttcaaggcctggtcagcggctttttgattggctttggtcagtgccatagcgagttcgtcgccagtcaaagcggcaacttgctgatccgtgacaataatgtggtgaccaagttgaatcgccaattccttttgtactgtttgtaattccccgtgtagttcatggtagtgggcgtcgactaggataccgacgtgcttgaaaatccagtatgctgaggtagcatcgtatttttctgtagcaacttgataagctgctggagtggtcgtagcaccggcatagaatggaacgtagacactttcagcggctacacccatcgccagccagtgaatcccgctcagcgtgacgggaaggtccggtcgcaattgtaagacgtgtgattcttgcgtcttggcgagactgatgggccgatactgatgtttctccgtagcagtgccctggccgacgggatcaaacggtgtgccttgataatgggacgctaagtagccttggacttggtcaatatgaattaagccatccgcccgttgaatgaacggtaagtcaaacgactcaggcgtctgggtgacacttggtgtaaagcatctttgaccataccaaacgcgaggcgtgttgtaatatcgatcagaaaggtcggccgtaccgaagacttcccggaagttcagtccattgtccattgaagctaactgattgtctaatacaaaattacgaatgtctttagcataaagataattgtcatggtcactaaagtcgatttcttggattgcaagctggttagcaacgactgcataggcatcatccgggattcgttgtgcgacccagtaatgaccagcaccagtttccatgtaccaaacttcgttgacatcactaaagagaatcccgttagtttcgtaggtgccgtgttcttcaataatatgcccgagacgttcaacgccttcacgagcagaatgaatgtacggtaaggtgacagtgaccattgcttcttcaccgatgccgtccttaacatacgggtcagcagccagtacgcgtgtattacagtaagcactttcagtagcactcattgccacgccgtactcgttaatgccatcctcctcgaacaggccatattcggcagtccattcaggggtggctgtgtatttcgcacgaatctttggcagggtcatggtaaagggatgagtttgatcctgagacttgaaggtctgtggttcttcgaattcgcggtgcgcgtggataatcatttttttcgcccaagcggcgcgtgaatcttcattacggccaatcatggtcgaaccatccgcgctggcatttttacccactaggatactagtgcaggcggaataaggattaaactgatgagtcaacatatggggccttctttctccacggtaggagcagtcaatggcggtatcgtggcataatcatttttgttaaattaattttagcatgtttagtcatcaatgggggttttcggtttgtgcttctgattagttttgcaaggtagccttaattggtcagcgtgctgggcattagaaaagaaccgttaaatcaacaacgtcgtggcttgcaaaatagaaaagattaaagtaagattaaaacattcgaaaatagtgaattaagataggagcgtggcctcatgccaatcgtacacattgatctaattgctggtcgttcacaagaacaacttaaaaacttggtgaaagatgttactgacgcggtcagcaagaataccggtgcaccagcagaacacattcacgtgattttaagtgagatgcagaaaaatcgctatagtgttggtggtgtcttaaagagcgacgaagaagcagaataggttgttcattgccggaccggtcgaatatgacgtggccggctttttttaaaagtttagaaggtaggttaaactgtgaacgaacaaattaagacggatgcattaaattcggcgcaccatttaatggtcgggggcgtcgatacattgacccttgcaaaaaaatatcaaacaccgctatatgtctatgataccggtgaaattcgtgccgaaatcgcagcattcaagcaagtttttgaagaaaaccacgtggactatcaaatcagttatgctagtaaggcgtttgcaacggtcgcgatgtatcaattgatcgcccaagaacacattcattgtgatgtggtttctggtggtgaattgtataccgcccaacaagcagatttcccaatggccgccgtctcgtttcacggtaataacaagtcactggccgagctaaccatggccttagatgccggtgttggtaccatcgtggtcgataatttcggtgaactacgacaactgacgacgttgacgacgcaacggcaacagccgaccacgattatgttgcggattgccccagggatctcagcgcatacgcatgattacatttcaactggtcaggccgattctaagtttggatttgatttggacagtgggcaagcagaccaggctatcaaagccgcgcaagccgcatcatatttgaaactggtcgggattcattgtcacattgggtcacagatttttgaagtgaatggttttaagatgattgttgataagctcgttagtgagtttgctcgctggcaacgcgaacttgatttttacccacagattatgaatgtggggggtggctttggcgtgaagtacactgccgaagatcatccgctacagccaaccgattttgtcgatgcaattattaaggaaacgcgcgcgcaaactgcagccaaacaagttccaatgttagaaatctggatcgagcctggacgctcgttagtcgctaccgctggaatgaccctgtatacgattggcgatgagaaggatattccgggcattcggaagtatttgtctgttgatggaggtatgggtgataatattcggccagctttatatcaggccaagtatgaagcggtattagccaagaatccggccttaccagctgaacaggtagcctcgattgctggtaaatactgtgagtcaggtgatatgttgatctggaatcagcaattaccggccactgcaccaggcgacgtgttagcggtcctagatactggtgcatacggttattcgatggctagcaactacaatcggaatccacgacctgccgttgttttttgtgaacagggacatagtcaacttgttgtgcagcgtgaaagctatgctgacttaacacggctggacctcccactctcagtgccggagaaaaccaagtagattagtcaccaaaaagcatttcaagagttaggctcttgaaatgcttttttgggtctgctgctgtcgtcgaagggcttgtgtcaacgtttgactaggatcagtgctaaaatgggcagtatgaatttattagttacggtatacttatcattgaaggatgttaatggctgctatgaagtcattacgctggtctgaagatggctagcaggggtgccagcatgtggcgtgggatttccaagtgaccggttgcatactggccctaatttttttgttaaatctatccgctttgcttgcgttaggcgtgaagtttgttaaaatttgatagttaaagtcttcgacggtgacgatggtcaataaggtcccaatagataattaacgatttaaataaccggtgggggagttgttaaaatgtttaaaaaatggctaacttggccagtattctatgagctgacagaaatttatacggcaccacttaatatcatgtggtttgttctcggaagcgccattgcgcaatatcacttaggtacggtgaattggcttaacgtgacgctgtgtttagttagcgtatttatttttgatttagccgtcaatgtttctgataattattatgattatcggcatgctcgtgatcgggaaggctatgcgcagaagacgaatccgattggtcgcttgcagttacccgtagcgggtgtcggccgcttagcattgggattgtacctgatttcattgattcccggaatctggcttgtcatgcggactgggtggttagtgctcgtccttggattagttggctatgtgattggtattttttacacagctgggccctatccaatcaacgcgaccccgctgtgtgagacggtcgtggcgttagcaattgcatttttaattgaattgacctgtgtggtcgtatcgacgtatggacagcatccgttgacttggtcgatcgttgggacgactttcttactatgtttaccactgaccctgattttcttttgcctacaactggctaataacacagcggaccgtgatgaagatattttgaatcatcgctacaccttggcctactaccttggtaagccaggttcggtacggctgattcaagcgtttttaattattggtggcatttggccgctcgtgaacgtcttactgggactagcacccattgttacgatttgggtcgtactcttactaccaattatgtggcaaggtatgcgcccgttctttgaggtgcaagataaaaagaagacgtttattacgacggtcaagagtgcctcgctgttcttcattctatacccagtgctatttgttttagggacttggttgtaacgaattagtaaagctcacttaatttttcgcacttatcgtggttatttttatgaaagtggactatattattaccagtttataaaataggggtaagcaggatggaaacagaacagcgacagcaacgaagaattgcggtgtatcacttaattgtcacacttttgacactctggtcagcagttaacgtgatcctattatcgtttcatatcggtgattggcacgttgaaacccgcatcagtaacggcttattagtcatgtttgcggtggactactttgtgcgcctaattcgttctcgagatcggaagacttttctcattcattcagcgttcgatttgatggggattattcccatgcacccggtgtttgcactctttcgacttgggcgtttggcacggatggtccaatatcaccatttgttctggaagctcggactggatggtaagtggacgcacgattttcaccgctttatctatagcaccgggtttatctacctgttttcaattagtattgcgattattgttcttagtgcgttgctcttttccgttttcgagcatcaaagcctgtcagattcactgtggtgggccatcacaacggcgactaccgtgggttatggtgacgatacgccccatactgccgttggcaaagtgatcgcggtcgggctgatgttcggtggaattggttttattggtttgttaacgagtacgattactgacttcttcacaacgcaagccagtcagaatgtcacgatcgaggaaccacagcatgatgacgagctgcgacaactactgattaaaattgacacgttgacgacgaaggtcgatcatttacaaaatcaagttaaacgtttagaaaaatcaggctacaaaaaacaacattgaattttcggaccgttggatgcccttaatggggcgcagcggtccgttttgctatgctataataacggtaacaaattcgaaacggtggtggtgagatgggacaagcaataacacggtgggtctggctaccagccccaattgtgacccgtcaatcaacgtttaaaattcatgtgggggatttacagcggcatccagtgccattacgtgccgcacagtggtatcaatttgagcagtcacgaacaaagcgaatctgctcggtgccaatcacaacgactcagtatgcggccgttacgcacttagcagctcagcggcttaaagctggtcaagcgggaatgttaccagcacccgagcagcccgtgatgacccgggggacgacgattacattcacaatgtaaagcggcgtgatgaaagttacttactgtaaagatactttgtgaatggtacttgacggttggggggcacgatgctcacgtgttatattcaggctaatcaaattgccgcgaggtcgcgaattcacgagggagtgatttttcgatgaaaacacgctatcagttacaagtcaagtacgacggaatcagatcgttaacacgttgccgcgtgttggcaatcatcattgcgagtttcacgggttggctgaccggctgcgaattagcgcaggccgccacggtgcctactatgatgcaaacttaccatccttggtccgtacgggggctgaatctagaaagcttgcgtttgctggtggcaacgaccgtcttagggctagtctgttggggcctagccgcttacttaaaacctaaggccaagtgagactgagtaaacaaacgattgttgtctgacccttgataggggacggatgataatcgttttttcttaccgcttatgtggcactgagcggtgtcgttcaatgtgggagcgcccattcccaacgtgcactagcacgccacggacctcgcgcgcagcaggtgagctgaggaaaatgatggcgaccagcaaggcaagtttggtggtcgcgttcacaatttaaaatgatcccagcttgttgattcgctgttagcaattggttgaatgaaccggtgatttttttaatttacatcttattaattaaaaaattgattaacgctaaagctagggctatgctggtaaagacgggtatttgtaaacaaaaatatgggcgcaaggacttgcatataaattaaaatatgattaaaataagtcttattaaattaatggaggcttgcgaatgattagtcaaaaccatcgtttggatcagcaacttattgaacgtgaagaccattatatggcgacggcggcacgaatcaattactatgatttagttattgaccatgctcacggggccatgcttaccgatgttgatggcaaccaatacatcgatttgttagccagtgcttcggccattaacgtgggccatacgcaccctcgcgttgttaaggccattcaggaacaggcagccaagttgattcattacacgccagcatattttcatcatcaaccggaacaacgattggctgagcgactggcaaaatcagctcccggcactgataatgaggtggtttttggtaactctggttcggatgccaatgatgccattattaaatttgcacgggcctatactaaccgacaatacatagtcgcctatacggatgcctatcatggttcaacgtatggctcaatgtcactctcaggagttagcctgaatatggtccgtaagatgggaccgttactacctgggatcgtgcacgtcccgtatcctgattgttatcgtacgttgccgcatgagacggaacatgaacttgcattacgctattttgaagcgttcaaggcaccatttgactcatacttaccagcggaggaaaccgcgtgcgtcattattgaaccgattcaaggtgatggcggtatccgcaaggcaccagcagagtatgtccaattagtctatgatttttgtcaccagcacggtatcttatttgccgtcgacgaggtcaatcaagggatgggacgaaccgggaagatgtggagcattcaaaacttcccgggaatccgcccggacttaatgtccgttggcaaatcactggcttcgggattaccacttagtgcagtgatcggtcgccgtgaagtgatggagagtctagcagcgccggcgcacacctttacgacggcggccaatccggtttgttgtgcggcggcgctggcgacaatcgacgttctagcagatgaacagttggttgcccgttccgccaattatggccgctatgccaaggaacagtttttagcgcttcaacaacgccatcctaaaattgggcaggtacggatgtacgggctgaacgggggcattgaattggtgacagaccggcagagtcagcaacctgatcctgattttgccagtgacgtcatttatgccgcttttgaacggggtgtcgtcatgataacgctcaaaggaaatattttgcggttccaaccaccactagtcatcacgaagacgcaattagatactgcgttaaccgtattagatgaggcaatggctgctgctgaacagggcctggttaaacggccccaaggcaagattggttggtaaaataaggaggattttgatgcaacggttattaaaacggttaactttaaaggaagatccaagcatatatgaagacaaagattctcacctagctcgagtattgacggtcaaggacttcttggctttaggggtggggacgattgtttcaacgtcaatttttacattacccggagtggtggctgcgaaccatgcgggccctgcggtagtcttctcattcatcgtcgcagccgtcgttgccggcctggttgcatttgcttatgctgaaatggcggcggcgatgccgtttgccggttctgcttattcgtggatcaacgtaatgttcggtgaattctttggttggatcgctggttgggcgttgcttgcggagtactttattgcgttggcattcgtcggttcaggactgtccgccaatctgcgggggctcttgtcaccattaggactaactctaccgaaagctttgtcaaatacgtttgggactgatggtggtgtggtcgacctgattgccgtcttggtgattgcgctggtctcgttactgctctcacgtggaatcagtaaggcctcccgggtcgaaaacgtgttagtggtgttgaaagtgttagccgtactcacgtttatcgtcgtgggtgcgacggcgatccacgtgcaaaactacgtcccgtttatccccaagtatcatttaaacgctgatggtagtgcttttgggggctggcaaggaatttatgccggggtatcgatgattttcttagcttatattgggtttgattcgattgccgctaattcagcggaagctaagaatcctggcaaaacaatgccacgaggaattcttggttcactcgtcattgcggtggtactctttgtggctgttgctttggtcttagtcggtatgttcaaatattcatcatatgctaataacgctgaaccagtcggctgggcattacgacaagctggccatccgattgttgccagtgttattcaggccattgccgtgctgggaatgtttactgcgctgattgggatgactttagcagggtcacggctaatttattcctttgggcgtgatggtatgttacctaagtggcttggcaagttacatcataatcaacctaataacgcgctacttgtgttaacaatcgttgctattatcattggggcgttttgcccgtttgcttttctggcccaattgatttcagcgggaaccctgattgccttcatgtttgtctcgctgggaatctatgctttgcggcgtcgtgaaggtgttgatattgcggtaccagcctttaagatgccgttctatccagttttaccagctattgcctttctaggcgcactgttcgtttttatgggcttagatatccaggcaaaattatacgcgggcgtgtggttcatcgtcggcttagtgatctactttagctatggtatgcgtcactcatatttggctgaaaaacgtctgtctaagactgatactgcggctaaatcagcttcgaaggtggctgattcgaccgttgaagagcgtgactgaacttagctaacgcaatcccttgatagttgaacaacaactaaaatggcacttccagaattgaattttatctggaagtgccatttttgagtggtgattacgagctagtgtaaagtccgaaaattaatagtgatgcgcagtcagcaacttaagatacaactgtcgactacttgcatctgaacgattattccgcaatcgcaaaataatcgttcaagtaacgagcaacaccgttttgatcattattataggccgttacatcgtcagccgttgctttgatcttgtcagtaccattggccattgccacaccgagacccgcgtatgctaacatctcgaggtcgttatgttcgtcaccaaaggcgatgatattgcgccgtgaaatttgaaagtaatccgctaagtaggcgacacccttggctttgtggacgcctttggaggtaatctcgaggatggcattcgggccgccccaaacaccaacgtcaacttgatcgccaaagcgttcagtgatccagtcaatgatggcagcccgccgatcaagctggactagcaagacgagggaattcggattacgagtcaacgtatctggtgtaagtcgggggctgtcagcaatctctgggaagaattgaccagcaatcaaatcttgacccgctgtcatggtactgtttttattttctgcaataatttcattgatccccaattgttcgcgatatttaacgagtgctaagacaatcgctttgttgattgtgaactgatattctgaggcccatgtttggtgaggtaaatggcccagagaaccgttaaagttgatcattgggcttttgagacgcagctggtcatagattgcttgtgaaccctgatatgagcgaccagtaataatgctaacaatgtgacccgctgcttgtagtcgttgcatcgtttggatcgtcgctgaattgagtttggattcagcattcaaagtggttccgtctaagtctaacgcaattagttttctttccatattcaacaaacatctcccatatttccggcagttaattaatttaatttagcataaatcccacctaattgcgaatctttgctaccttacagtcggggcaaaatgtggtaatctaattgaggatgctttttaattgaggaggaaatttgggtgcaattaccagcagaatttattcaaaaatatcaacgactactaggcgatcaagcgcccgcttttttggcagctttcgatggccctgttgaaaaagggtttcgggttaatccgaacaagagtgtgacggccacgatgcgcgccaagatgacagcacccgttccgtatagcccaattgggtattatggcaaggtgaacggcaatgcgctggaacacttggctggtgccgtctacagtcaagaaccaagtgccatgaccgttggcgagtttgcaaaaccagaacctggtgaacgagtgttagacttatgtgcggcaccgggtggcaaaacgacgcatctgttaagctatttgcgtcagactggtctactcgtgacaaatgagatcaatcggcaacgggtgaccgcccttggcgataatgtggaacgctacggcgcccgcaatacagtgattaccaacgatacacccgccgcccttgccaaggaattgccaggcttttttgaccggatcttggtggatgcgccgtgttcgggtgaagggatgtttcgtaaggatcatgacgcagttcagtattggacgcccgactatccagcggcgtgtgctgaacgccaacgggagattttgacggaagcggtcaagatgttgcgtccgggtggacatttgatttattcgacctgtacctttgcaccggaagaggacgaacagatgatggcctggctgttaaaaacttatcctgagtttgagctggagccactggccaagacggctgggatggtcgatgcaaagccggaatgggcggatggcaatcctgaactggctaaagcggcccggttatttccgcacttgatgcgcggtgagggtcactttattgccaaattggtctatcatggcacgacggtgggcaaggacaaaaaagtggttcgcgaacagttaaacgccacgcaacggcagctatggacggactttttaaaaaaacaagcaatggccggtttaccacagctcgtgttacaggcacatggtgatcagttatacggcgtgccagcgatgatgcccgttacgcgaaagctcaaggtctttcgccccgggattttattgggaacgtttaagaagaaacggtttgaaccaagttacgcgttagccttagcgagtgatgatttgtccttacccaaaactgaaataacgcgtgaacagtgggcattgtatgtccatggtgagacatttgaattgacaagtgcgcctgtagctggttttcgggtcttaacttgtgatgggttgccagttgggtttggaaaaatcgtcgccaagacggttaaaaatttctttcctaagggcttacggttcttggcgacctctgaaaacgcgacgctctaacctgacatgatattgactaagtcataacgtccgcgtgcgattgacgctgaacaggtgatgagcagcggccgtcatgaatcattcgatccgtggtaaaatcgggggaacgatctacgcaagttgatggtcaaatggacccaatcaatcgtgatattggaggaagagtttatgtattgcccaaattgtgggaaaaagaatgatattgacgcgttattttgtgaaaattgtggtgcgcggctgattatcccagccagttcagcgcaaccaacaccggcgtcagctgtaagttctgctactcaatccacgtcgtcaacggctgcttcagaagcaccgagcgccagtacatcgatttcggctgcaccgactgcacctgaacctggcacccgttcagcgcaacatgcgcgtcaaaatgcgcaaccacgttcaacgtcaaaactgtcttgggttattttgatcgtggtattagccgtggcacttggtggtggctattactggctgggacatcagcgtcagagtaattcgacggcaacagcgacggccaaatcttcgtcgcgcactgctacatcggaaaaagccgagtcgtcatcatcgtccaaggcatctgctagtacggcaactcagacggcattgtggtcgacaaccaagtcgagcgagttagcctcgtttatgtcgtcatggcaagataccatgaaccaatcgtacgaggggacttatgatggtcagtcggtaactattggtgagttgaatttaccttcagacatcaaaaacaatcagtaccaagataagattacggtcaatggtgacacagtcaagctcaagtggacgacggctgctgataccgatgcgaagtaccaagtcgttgccgcggccactgatccgaacgcgtctagtggcgtaattacgtatctgtatgttttccataatggttcgccagacgttctggtctcgcaagacagtgccactgccacaacgtttaacttcactagttcacaaaatacggatttacaagatggctttgcaaagattgccaatgcggattaataactgaattattcggaatcgtgtgtttatgctaagtcggcctgaacacacgatttttttgcgccaatattcgacagaaaatggcgtattggcgctttaaaactgaataattagtgtcgggtaatggaaagcgatgctgatttacaatcgattattgaaaattattatttacccgaattgtcaaatcaagnnnnnnnnnnttcaattttaaatccggcaaattattatttatttacaaaatgatatccgtcggctggagcggtttattagtgcaacggcacgcaacgtttcagcgcctgcatctatttgttcatgcaacagtatacaatataatgacttttttatgaattatatgtgaattttatatgaatcgatgtatcagctaatactatttgaacccttgatattagccgatttcatgccaaataggcacggatgtcaataagtaaaacgccttcatgcaatttcacgcaaacgcttgcataattttggaagcggttttataatctaacttgtactcaagcgattgatattatttttgggaggctttattgtgaaagaaacatctaaaacaacggccggattaccgaaactgtcatccaataagatttggatgatgagtctaggttttctcggtgttcaaatggcatttacacttcagagctcacagatgagccggatcttccaaactttaggcgcggatccaaataaccttggctggtttttcatcttgccaccccttgctggtttgatcgttcaaccgatcattgggagtttatccgaccgaacatgggccccacgtttaggcgggcgacggttaccttacttgattctgggaacagtcgttgcggcaatcgtgatgttactactacccaattctggctcgtttggatttggttacgcttccatggcggccttagtttttggtgcgattaccgtggcatttcttgatttatcgtctaacgtcgcaatgcaacctttcaagatgatggtcggggatatggtcaacgatgaccaaaagagttacgcctatgggattcaaagcttcttgttgaatactggtgccgtcattgcggcaatcttcccattcctgttgaccttgttcggggtcgccaatacggctagtaaaggtgttattcccaattcagtgatctggtcattttatattggagcagcaatcttagtggtttcaacgattatcacgattgcccgggtgcgggaatatgatcccgtaacttacgcgaagtatcacggcattgatgaaagcgctaataaatctggtggtaactggttggcactcttgaagaaagcaccaaaggttttctggttagtagccttagttcaattcttctgctggatggcatttcaatacttatggacatactcaaccggtgcaatggctgccaacgtttggcacaccactaatgccagttctgcaggctaccaagccgctggtaactggtacgggatcttatctgctgttcagtccgttgccgcggttgtttggtcatatgttttagccaaggttccgaataatcggcataaacttggttatgctttgagtttattacttggtgcaattggcttcttctcaattttcttcattcacagtcaatcagcacttgtcgtctcatttattctggttgggatggcctgggccgcaatgaatacgtatccattgacgatggtaaccaacgccttatctggcgaacacatggggacttacttgggtctctttaacggctcaatctgcctgccacaaattgttgcgtccttattgagctttgcattatatccattatttggcaattcacaagccaacatgttcatctttgctgggatcgtccttgcagtaggtgcgggcacagttggtttgatcaaagaaacgtacaaaaactaggaggaattaacttatgaaacgaatttttgatgttaatccatggcatgtcttgacgactgatttcaaaccagaaaacaaacggctgcaagaatcaatgactagtctaggaaatggttacatgggcatgcgcggcttctttgaagaagattatactggggatacgcttcccggtatttatcttggcggtgtctggtatccagacaagacccgggttggctggtggaagaatggctatccagaatactttggcaaggttatcaacgccgtcaatttcatcaaaatcaatttcaaactcaatgggactaagatcgacttggcaactgccaacttcagcgattttaaacttgatttggatatgcaacacgggactttgacacgatcatttatcgttgatcaagatggtcaacgggttcgcgtgacctttgagcgtttcttgagtgttgcgcaaaaagaactttcggttcagaaggtgacgtttgaaaacttgagcgatcaagcggtggaattaaaagttgcttccgcactggatgctgacgttaagaacgaagatgcgaactacgatgaacatttctggaacgtccacgaagttacggatgatcggttaattgctcagacggtaccaaatgattttgggaccccacagtttacctctgggatgcaagttagttatgtaacgagtttaacccataaagcggccgaagtgactgatacagccacggttgatcgctacttcggtacgttagaagctggggccagcgttagttttgaaaagcgggtcgtcgtggttacgtcgcgggattatccgactgatgatgccattatgactgcacttcaacgtctgacagatacggtcagcgcccaatctttcgatgatttattggcggcccatgaagcgggctgggccgatcggtggcaacaatcagatattcaaattgaaggcgataccgaggcccaacaaggcatgcgtttcaatttgtttgaactctttagtacttattatggtgatgatccacggttgaatattggaccaaagggctttactggtgaaaagtatggtggtgcgacttattgggatacggaagcatttgccgttccagtttacctggggattaccaaaccagaagttacccgcaacttactgatgtatcgttataagcagttggatggtgcctatcataatgctcgtcaacaagggcttgatggggcattgttcccaatggtgaccttcaatgggattgaatgccacaacgagtgggaaatcactttcgaggaaatccatcgtaacggcgacattgcctttgctatttataactacacgcgttataccggtgatacatcatacgtcttacatgaaggcagtaaagtgttgacggagatttctcgtttctgggcagaccgggtgcacttcagcaaacgcaatcagcagtacatgattcatggggtcactggcccagatgaatatgaaaacaacgttgataataactttaataccaattatttggcgcaatggacgttgaagtacacgcttgaaattttagatcaggttagtgacgaccaagcagcggccttaaacgtgactgctgaagaacgtgcccactggcaagatatcgttgatcggatgtatttaccatatgacaaggatctggatatctttgttcaacatgatggttatctggataaggatttaacgcccgtttccgcaattccagctgaccagttaccaattaatcagcattggtcatgggaccacatcttacggtcaccttatatcaagcaaggtgatgtgttacaagtgatgtatgactttattgatgatttctcaaagacacaattgaaacacaattttgatttctacgaaccgatgacggttcacgaatcaagcttgtcaccagccatccatgccgtgttagctgctgacttacactatgaagacaaggctgtggctttctataaccggacggcacggcttgatcttgacaattacaataatgatacggtcgacggtcttcacatcacctcaatgactggtggttggattgcgatggtccaaggatttgctggcatgcgtgttcatgatggacaactgagttaccggccgttcttaccaaaacaatggacgaagtattctttccgtcaggtcttccgtgatcggattattgaagtcacggttgatcacgatgggacgactttgaagttgattgccggggaaccgattgatgttcaagtggatggtaccacgcaaacattgacacagaactagttcaatccgcactgatcgaagggaatgaggcgtacgatttctgcagtaccatttggtgtgtatcaaggcgagtcagtctatttatacacgattgaaaatatccatcatagcaaactaaaagtgttgagttatgcggcaacgtggtatgacttcgaagtgcaggtcgaccgccagccacactcattagtgcttcactttgataacttggcggattatatcgagacgccttatcaagtcggcaaaacagtgggtcgagttgctggccgaatcggtaacgcgacgttttccttgaatgggcagacgtatcacttaccaccaaataacggccagcatttgctacacggtggcaatcatggcttacaaacgcataattttcgagctcgttttgatcctgatggcgacactgtcacattgacgacaacgctagcgagcgctgacgatggttttccaggcgacttgacggtaactgtaagctatacgttaacggccgatgatgaggttcaaatcagctatcacggggtgaccactgctgatacgttattcaatccgacctgtcacgtttactttaatcttgatggtcaggccgcactgattaatccccagcaattacgtatcaactcgaccaagctagttcatacgaatcacgagaaggttccgaccggcgtcttctacgtcccgtcaccagcgtatgactttcgtgagcagccaacgattcaatcgcagctcgatcgattgatccaagaaactggcaggacggaatacgatgattgctatgtgcttgaccaccaggatgaacccgctggcgtgttggcaacgactcacgggcgactgctcatcaacacggatcgcaatggtttagttatctttaccgctaatcccgaacgaacgcagtcgtatcgtttaggggactaccatgcgctggccgtggaattgcaaaccttgccggatgctattaatcatcatggctttggcgatgttgttctacgggctggtcagccacggacgtacgtgaaccgctaccaatacgtgtcaaaatagcaatcaatagatgatggaaattattttctttaccacgatcaaaaagcagtgcttgccataggggcacactgcttttttggtgtacttggttataacaaaaacgcgtcatcacaagtatagaatgacattccgtagtttgtgatgacacgctttgttttaatctttaatcgattgcttgtagttaacaagttcaggtgataacagaatcttgtcctgaatacggctacttttgaattgatcaacacgcgttacgccgacgagtgcaaataggcgttttaattgcgactgccaatccgtcagcatcgcaatgacttcgtcgtccgtatgatggagtaaagcgtgtagcacggtgccagccatgccgaccgcgtcagcgcctaacatcaacgcttttaagatgtcgagtggctgtcgaacgccaccagcagctaagaccgtgagatcatccggtcggttctgaacgcctagcaaggactcaaccgtggtgaggccaaagtcgtgaaggtaggccatatcgcggttagcacgtcggcgattctcaatgtcgacaaagttagtcccaccgtgaccgcctaaatctaggtagcgtacgccggcagcgtagagctgttgcatcgtggggcgggaaataccaaagcccacttctttgacgatcactggtaccgttaaggcttggactaagtccgaaatgttagttagccaatgaaagtcacgatcgccttctggcatgacgatttcttgaacgacattgagatggagctcgagcgcatcggcctggagcattgcaatcgctgtttgggccgcagataacgggtggccggcaccaagattgccaaagatcagcccgttcggattgtggtcacgcatcgtggcaaaagtgggggctacttggggatctttgatggcgacactttgagagccggtcgcaatcggtaagccacaagctgcagcgatgcggcctaaacgagcgttgatttcgcccgttcgctgtgagcccccagtcatcgcttcaatgtagagggggctgtcccaatgccactggccaacggtggtggctaaatcgacgtcggccacggcagtttccggcaacgcgtcgtggcgaatccggacctggtcaaaggcattggcttgttcgccatgaaaatacttttcagctaacgaaacatgttcatctttccgatgagattgttgactttgtggcacggtgccacctccaattaatttagaatctgaaaacgagtccggcaaggctgccaggctcgtcaataaactgcttaagaatttggtaaaacggtatcctgaaccgtatgcacgtttaagttaagttgtgcgataccatcgtgagcccacgcagttaataatggtcgtgggtcgatggtttgatcaatcaaaacgatcccacagtcaccaccaccagcgcccgaagtctttgcggccgcgccagcactttcggcgagttgaatcatacgctgcagcaggggtgtttcaatcgtcacgtgactgaaatcgcccaatttctgaagtagttgacgattcgttcgcaactcggtttgaatcacgtgcaagtcactgtgatgaaaaccagtgatcatacgttttagacaagctttgctggcttttagaaaggtctggtattcgctgcgttgcttcgccttgactaaagccactttatcgactaagtgtgatgtggaggccggtgaacccgtccaaccaatcatcaaacgtaaggctactggaggggtcagtaactcgatttttaggtcgggccacggcattgtcaacaaatcacttaagcttgactgagcttgttgtaggtgtaaccattgccgatcgaatgaatggtaggcgatccagccaccatagacgctggcagcaatgtcaccaagcgaaccattgccttgcacggatagatgggcaatcgcggctaatttgaacagtttatttttatccatcggtaaatggtaaaactgacatagtgctttgacggttgccacggtcactgctgctgaagagccgagaccgtattttttaccatcagcactatcgagttcgctattgataccgagatgataaacaccaagttcacgccctaattcatgggcataactttcagtgagattgatcgctgctaaaatataatggaagggattgtcacgattatcaaaaaccatcgcgtctccctgacgtcgccagacgattgagttttcttgatactgctcagaaacgatgctcccaatcgtttcgctaggtgaaatcgttgccgtcacaaattgatctagtgcaacaataattgctggataaccactttccactacggcgtattcaccggcaatgtagagttttccaggggctttcaccgttatcatgccatcatatcctttcatgaccatcgctgatcattttaaattaaactgaattatttttccgttatcgtgatacctggacctggtttagcgacgattaattgatcagcgtcaaaatgttgttgtaacccggtcataatggtgtcggtatcttgacccgcacaaatgattttgacgtttgggccagcgtccaaagtataataacagtttatcccgtgtgaacgcaagtcgttgactgcttgaatagccgtcagtgtatccgcggtgaagtagttaaaggcgggttcagcgctcaaattaagcgcgtgcattcgcattgcgttcgtttcagcaatttggccaacagtagtgagatcacgatcggcaatggcttggcgcattcgcttcaagtccgtctcagccgtggtgatccaagctggatagtagggggatgtcgcgacgacccgtgccatgccgtccgttgagctgattggctttttggtggccttcaaaacaacggcgatcatttgaatgtcccaatcgaccgggtcttgtaagacttccgcgtaagaactctgatcatcatggccggcatgccattcgacaaaaccgccaaaaattgagcgggtcgcagaacctgagccacggcgtgctagtcgtgatagatcagccgcatctagttgtaagccagccgcacgactagcagcccctgctaaggccgcgaatccggaggcggaagaggctaagccagctgaggtcggcacatgattttcagttttgaccgttgcatagttggtttgaccactgcgctggcgaataaggtcgaggaactggctgattcgtgctgatttgcccgtgggtaagtgttgatggttaaagtaaatttggtcagtatcgagatgctcatcgaaggtcacactggtctgggtatagaagtgatcaagggtcagcgaaatactcccattttgtggtagcatcagcgccgcatcttttttcccccaatatttaactaacgcaatgttagtatgggcctttgccgtaacggttttcactatgtcttttcctccaaaattaaaattagtcatcgcacaaaagtggttcgacccaagtcgcagtcgcaccggctgcggccaatttttgtgataattggttggcgatgctggcttccggagcgagcgcgatcaagcaaccgccctgaccactaccggttaatttggcagcgagtgcaccattttggcgagccactgcgagtagttgttcaagggcaggatgactgacacccatggaacgtaagtcatcttgcgcaccattcagggctgttgccagggcccccatgtcaccatcttcaagcgcggttcgggtctgacgagtcaatcggcccaagtcatcaatgcgtgcttgaatcgtcgcgccctcaaccattagtaagttgcgaacggtcgccactgcaactttggtctgacttttaatacccgtgtccgcgatgactaaatagccgggaatctttaccggaatcggaaagttctcacgacccttgacaaaccagacgggacttttggcactggccgtcgcaacgtctaggccgctgggttgaccatgcgtgtaactttccgccacattggcagtggccaataattcttggtgggagagtggtcggtcgaagaaatcataaaaagcccgcgttacggccacggccgctgcggctgaggaccccattccgcgttcagagggaatatcgctcgtgatgtgaatatcgaagccctgctcgggggcatcaaaacgtgcaagcaaggttctaatgagcgtctgaataccgcctaagttggcagacatcatcttaaagtcgccgttgaagtaacggcttttgaccgtctgcgctgcatcacggcggtgaataatggcctgcatttggatggtcgaaatcggtaaggcaatggcgggttgtccgtaaaccacaccatgctcgccaattaaaataattttggcatgactagtaccggtagctagatctttcaatcgtgtcgctgcctttctgtaagtagattaataatagcttcataataccttattagcacttcttttgccatgctaaccccggcgaacgcgctgaattcagttgaaatgtaagttaaactggtttggaaagtaacaatttaattaaattaaatcattcacgtgaggggcgtatggacagactggttatcaacggcagacgaagatcgattactatgttaaaattagtaaatgattagaaatcagtccgataatgatgaaaaagaagttgagctgcttgtgacggactacgtggcccagaattcactaattaggaaagtaaattttgggtagcagtgccggctattcaagcgcgcgtactcagctgactgtgttatggcagatgtacgccgagacactttcatgaactttatcgttgctcaatcatactcttgaccagtctctgcccgttgtcctcagactgacgaatttggcttaagagttggtcgggctgagttccctacgccgaatatgctataatttacaatgatcgacgtgacgtatgtgtgacgatcggtgtggaggatgagccaagcggcttgcgtcatcaggacgacttgtgtcactggcacagtttagtaggttgaactcagctaagttgggctgaccgacgaaccgttaaagttagtggtcgagaccaagtgtagcgctacttggaccagccttcagtctgattacaaacacatcgcacgtgatatgccataaagatcgattagttggtcgaacatcagcgttagtgttgatgacggattcaagcggtaaccaatctaatgaacatctttacaatccataacttggggaaatgaccatgaaaccaaacacaacttatgcggtagttgatattgaaactactggaactagtgtgaaggacggcgaccggattattcaaatcggttgcgcgtttgttaagaataataaaataattaatacatttgccacggacgttaatccgttaacaacggttccggccgttatcgagaatttaacggggatcagcaatgcacgggtgcgcaaagcaccaccctttgatgatctggctggtacggtatacagcttattacaagggactgtttttgtcgcccacaacgtgaactttgacctgccatttatcaattcagaattgcagcgtgtcggttatccagaactaccaattcaggccgttgacactgtgtctcttagccaaattctgttaccgactgcttcgagttttcggttgcgggacttgagtcacttgcttgcgattgaccataatcatccgcattctgcggatagtgatgcaattgctacggcccatttgtttatcacgttacaacagcggctcgcacacttaccattgatcacgttacaacaaatggtgcaattagcaccggagttaccacgtgaaacggctgacttgtttgcatacgcctttcaacagggcaaacaacatccacagcagttaccaactgacttagtgatcaaaaacgggctcgctctgcgtaaacagcgattgccacagcaagccgcgggtcgtaaagcggcacgctatccgttgacaaaagcacaaaagcagcatatctttggtgatcgcttgacttatcggccacaacaggcccggatgatgaaccagatttatcggcactactcaaaacagtctgctgaacaagtaccattgttgattgaagcaccgaccggaacgggtaaaacactcgggtatttgctgccacttgcctacttggcacaggatggtcaacaggtggtcgttagcacggcgacgacggtcttacagacgcagttacgtgatcagggcgtggcgttgttgaatcagttgttgcctaatcctgtgacggcggttgtgattaagggtaatcagcattacgttgatttaaaccggtttgcccgtggcttggcgttgcatgaacattcgaagcaaacgcaattattgaagttgcgcgtgctagtgtggttgacgatgacaacgactggtgatctggatgaattgcacttgagcacgtatcaagcgccgtactttagcgaaatcgcccatcatggcgtggcctcgttgaaagctgatgacccgttttttaaagaagatttcttacgctttcgggatcaattgaccgcgcaagcgacttttatcattaccaatcatgcctacctgatgcgccacgtggcccaattgggtagccgtcaagagcggccactgctggttcttgatgaggcccagcatctggcagatggtgtcgttcgtgactcacggcagacctttgatttcaatggctacatggcgacctgccacagcttgatcagtcgcattgacacggaacatagtctaaatttacgggcactgttcgcggaacaaccacaggccgattatcgtctgaaattattagataattcattgaatgatactgacctacacctgcaacaactgcaggcggcgctagctagaacgtttgtaccagcacaaaagggcggcaatcagcctgctgaattaggaatcaccacggatcagttgactgatttctttgcggcccacaatccgctgatcaaacaattacaaacggccatcgaaaactgttttttacagtttcaacaattaaatgagcagtatcaacatgatcaatcgcaaatcttgcctagtgaacaacacgtcctcgacgactttgacaatcgtcttcaacatctccgtcagggctatgagttattacaaacgtggttagtgccagcttcgcgggaacaacgggtcttctgggtgagccttaatcaatggcatgatcgcggcagcctcacgctcgcgggtagcttgatcgatacgcaagggtattttaagacgcaactatatccttacttcagtgcgccactattaactggtgccacgctatttgccactgggaaatctcagtacgtttattcgcaattggatattgaccaagcaacggctaagcatcaccgattatcaacaccgtttgatttagaacaccaggcacggctattcgtcgctacggatgctactgcggcggaagcacccagtggcaagcagcgcgtggcatacttgacgcatgcgattcacgacatcgtgatggcagcgcctaagcaaacgttggtcttgttcaattcactgaatatgattgaagcagtcttttacagtttgcatcaaacggatctacctggtgatcgcgaaattttggctcaaggcgtcaatggtagtcgtgaaaagctgcttcggcgctttatgcagggggacgatgccattctcctgggtgccggtagtttctgggaggggatcgacttgccacaagaacagttggaattgttgatcgtcacgcaattaccgtttgaatcgcccgaccagacgacaaccaaggcccgttatcaacaactaaggcaagcacaactcaatccgttctataacgaagcgttaccgaaagcggcattgaagttacgtcagggaatcggccggttgattcggacggatgaagaccgaggggcagcggtgattctcgatgaccgtttgatgacgaaacgatacgggcagacgattcttaaagctttaccgaaaacgttgccgcccgcaaccggttcattgacgatgattacgcaggaacttcaaagttttttcaaaactaagtaagaaaccattccgcaatcagttaaatttgctataattaatttatctgtttttgaaaggaagagcatatgcgagttcaacgtagaaggcgccctgagcgactcattatgattattctggtcgtcattttagctattatcgtggcggtctatggcacgttatgggccgcacaacggccaatgcaccaagcccagaagacggcgtatagtctggccgtcagcaagggcaagctaaagaccacgacggccttttcacagtacaatggcaccagtagttattacgtcgttacgggaacgtcgagtaaaaatgttccggtatacgcgttaattaacgcgaataaacatcataaaacgaccgttatcaaacagtccgctgggatttcacgtacgaaagccttgaaaaaggtctggtctaaacgcaatcctagcaaggttatcaaagcgacgcttgggaagtatgatgggacggtcgtgtgggaaattacgtacttgaaccagaaaaagaatttatgttatgaaattttgcagtattctaatggaaaccagctgaaatcaattattaacatttaaggttaaaggagtgcggatgtacatggaattatcgcgtaaagtaatgcaggttcaaccgtcagcgacattgaagatcagtgcgactgccaagcaaatgatggcggacggcgttgacgttatcaatttaggaatcggtgaaccggattttcagaccccggataacattaagcaagcagccattgatagtattcaaaatggtcaagcgagtttctacacaccggcaactggattaccagctttaaaacaagccatcagtcagcgaattgaggctgaccatcactaccattttgatcctaatcagatcgtcgtaacggatggcgcaaaaatggcgttgtttacgttattccaagttattctgaatcccgacgatgaagtgttattaccagtcccatactgggtcagctattcggagcaagttaaattagctggtggtgtgccagtcgaagttagcaccgatgaacagttgcggtttaccactgctgatttggaagcgcagcggacgcctaagacgaaggccttagtcttgaattcgccacagaatccatccggtctggttttcagccgtgcagaattgacggcgatcgtgaattgggccgttgaacacgacgttttggtaattgcggatgaaatttatgaaaagttattatataacggtaatgaatttacatccgtgttagaattagatgatgctaatatggatcacgtggttttgatcaatggggtttcaaaagcctattccatgactggttggcgtatcggatatgctgccgggccacaaaccatcatggctaagatgggggtcgtgttaggtcacgctgctagcaacccagccgccgtatcacaatatgctgcgattgaagcttttagtggtgaccaatcatctgttgaaacgatgcgtcagggctttgaagcgcggttaaacgaactatacccactgatcgagcgtttacctgggtttaagatgcctgctggcaaaccagcgggagccttttacttgttcccagatattacggaagcattgcgtttaacaggctatgcagatgcaccggcctttgtgacggcagtgttattagaagcccatgtcggtttagtgcctggagaggcgtttggcatgcccggttgtttacggttaagctatgcaactgatatcgattccttgcgagaggcccatcgacggttacaaaaatttatgacagaaaaaattgctgaacaagcaaagtaattggaggatgtaagtaaatggtgcaacagatcaacattatcgatgctaaggaccatgtcgacgaaaaagtaaagattggggcttggctcactaataaacgttcaagtggtaagattgccttcctacaattacgtgatggctccgcctttttccaaggtgtcgttgttaagagccaagttagcgaagaagtttttgaactcgctaaggaagttaagcaagaagccagtatgtggattacgggtgtgattcatgaagacagtcgttcaaagttcggttatgaaatcgaagttgaagacattgtagtcgttggtgaaagtgaagaatacccaattacgcctaaggaacatggggtggacttcttactagatcaccggcatctatggttacgttctaagcggccatgggcaatcatgaacattcgtaatgaagtcattcgcggaacgtatgaattttttaatcaagaaggtttcattaagatggactcaccaattttgactgggagtgcacctgaagggacaactgaattgttccatactgaatattttgatcgggatgcctacttatcacagagtggtcagttatacgccgaagccggagctttggcctacggaaaggtctttacttttggcccaacattccgggctgaaaagtccaagactcggcggcatttaattgagttctggatgattgaaccagaaatggctttcatgcatcaagaacaaagtttggaagttcaagaacgttatattgcctttcttgttcaaggtgtgattgatcattgtcaatacgcactcgacattttaggtcgtgatgttgaaacgttgaagaagtacaccaagttaccttatccacgaatcagttacgatgaagccattgaattgttgaaagaaaatgactttgacgtggattggggtgttgattttggttcaccagaagaaaccttcttggctgatcacttcgatcaacccgtcttcgttttgaattacccgaaagccatcaagccattttatatgaagccgcatccaacccgggacgacgtggtgatttgtgcggatttattagccccagaaggctatggtgagattattggcgggtcagaacgagcaactgattacaattacttacttgaccagatcaaacaagccggcttaaatccagacgactatgcttggtacttagatttacgtaagtatggtagtgttcctcatgctggttttggtttgggactcgagcgattcttgacttggattacggccgaagatcacgtgcgggagacaattccgttcccacggttgttgaaccggatttacccgtaaactttaattgaaggttagttttattaagagcgtgggacctagtctcacgctcttaatagtgaaaggatgataacgagatggagtccttagctgccgcgttagtgaatgatggtcaaacgaccattgcgaacgcattattggcccactatcgtgaaattggggtcacaaacgatgaattattggtttatttgcagttcaaacggttaattgatcagggtaatcaattcccagatgctgcggtaattgccaagagtttaggtgaatcgacaaatgccgtttttcagcggctacatgaaatgttagccaaaaaattgctgacgattgaatcgatcacggctgatgaccaaaaaattcatgaccgttataattttgacggcctgtatgataagttagcagttgcgctcaaaaagcatccagttagcactcaagcttcggaacaagccacgagtgaaaacagccggcaaaaggtttttcgggcaattcagacggaatttggccgtgacttatcaccgatcgaaatggaaagtattagtaagtggttcgacgaagaccattatgaaccggaagttatcgaattggcattgcgggaagcagttctgcgtcaagtctataacttgacgtatatggaccgaattctgttgaactggcagaagcgtaacttaaaaacggctgcccaggtggaagcagagcgccaacgcagtattgagcaacgcttgaattccgctccgcaaccacaacaccagacgggcgcaaatgctggtccgaagattccgttattcaaattaggtgaagaccagtcttaaacactgtgctgaaaagcttatcggggaaaactgattttaaataaagtggtggcgattgcctgtgcgaggcgtcgctaccactttttttcgggatgggttagtcgttgtttcatatcaatggcgtttgcccacgtcattggcgcagcgtactgaggttaaaacaggaccaccaggatttcctgtcctggtaagccggtgggatgcacatcattggaccaaaatcagtgggcaccactataaattaaaaaatggttataattaaatgttgacttctcattaaaatagcgcaatactgtaaacaaccaagtaaatatattaataaatacgtctaagatgagtagccgttgttggaatgccttagagaactgccggttggtgcgaggtagccatttcgcaacgttgaagatggtcttataatgcaagtttcaacgctgagctgacggggttaagcgttgacggctacgcccgttatgcggttagagtctcgctaagaattttcagtggcggtacttgaagtgcggtggcctgtgagggtcatttgaagtaaggtggtaacacggaaaaacgtccattcgtccttaatctgataatcagattagagacgatgggcgttttttaatgggaggaagcagactatgacagaggcaatcattgatttaaaagacatcgcagtgacttttgacgacgggcaccaagtcgttcacgcggttcaagatgtcaatctacagatccagacgggtgatatttatggcattattggatattccggcgctggcaaaagtaccttggtacgggtgatcaatttattacagtcaccgacaacgggccaggtagtcgtcaatggccaggccttacaaacgctatcgccagctgcattacgtcaagccaggaaacacgttgggatgatttttcaacacttcaacttgatgcaatcacggaccgtgttgggaaacgttatttatccattattgggtcaaaaaattagtaaacaggaccgacgcgccaaagcattacggctactgaagctcgttgggttaacggactatgcgcagacctacccagataaattatctggtgggcagaaacaacgggtggcaatcgcacgggcactagtcactgacccgcaaatcttgatttctgatgaagcaactagtgcgcttgatccaaagaccacggcggcaattcttgagttgctacaacgggtcaatcgcgagctagggattaccattgtcctcattacgcatgaaatgcaagtcatcaagagtatttgtcatcatgtcgccgttatggctgatgggcggattattgagcggggccccgttgctgaggtttttacagcccccaaagcacctctgaccgttgattttgtggaaacatctaccaatgttcgggccgccattcagcgaatcacgaaaacgattaaattgagtgaattagcagcggaccaagagctgattgcgttcaaattcgttggtcaatcaacaaagcagggaattgtctcgcagttatcgcagacgctgggggtcgacgttaacattttgtttgccaatatcgaccagatcgatggtcaaaatgttggtgacatgattgcgattattacgggggatttaacggccttcaatgtggcggtcactaatatgtcggctcaaggtgtccacactcgcattatcaatgaagaagttgtgaagggaatggtggactaatgacagcattaattccgaatgtcttacaaatgaaagctgaatttattcaagcaacgttagagaccctctatatgaccgcagtttccgcgctggttgcaggaatactggggttgggtttaggggtactgttagtggtgacacagccccatggcattttagctgatggcccctcgtatcaagtgttagacaagctaaccaacttactccgttcggtgccatttattattctgttggccgtaatttcgccgttgaccagctatttaatcggaacaacggtggggaccacggcatcgttagtcccactagtttttggtatttttcctttttatgcccggcaagtgcaaaatgcgttactcgatgttgaccaaggaatcgttgaggctgctcagtccatgggatctagtcccattgcaattatttttcgggtttatttgaaagagggactacctgatttgattcgcgtctcaatcgtgacggtgattagcctgattggtctgacgacgatggctggtgcgatcggtgcgggcggcttgggtgatattgcaatcagtattggttacgctcgctttgaaaacgacgtgacgtttgtcgcaatgatcatcattttgatcttagtctttgctgtacagctgtttggtgattggctcgttaagagcgtcacacatcattaataaagggggaattagccgatgaaacgattagcatggtggttgattggtattgctgcaattgttggtatttgtgtgggattacatgaaataacgagttattcggcccgtacacaacagagtgccacgattacggtcggatcaatgggatcggactatgaagtctggcagcacattgctaaaagccaagatgccaaaaagatgggcttaacgattaaggttaaacaaatcacggatggtgttcagctgaacaaggccacggtggacggtaacgttgatgtgaacgcctttcagtcctggtcatattaccaaacttataatcagcagaatcccaaggccaagttggcggcgttaggaacgacttatttggaaccaatgggaatctactccaaaaaatatcaaagcgttgatgaaattccggatggcgctacgattgcaattgctgacaatccctcacaagcttcgcgaggcttgttactgctccaaaaagcgggcctgatcaaactggcagctaattttggtgtcttaggttcagtgaaggatattacaagcaatccccgtcatctgaaattcaaacagatcgatgatactactggtccccggatcattaaaagtgtcgatgcagttttgatttcgaatacggttgctttggaaggacatttacacgttttacgggattcgattttccacgaaagtctgaataagagtactagggataatgttaatatcttagcaacggccgctaagaacgagcatcgtgctagttatcttaaactagttaaactttaccatcgggcggatattcaaaagtatatcaagcaaaaatattacggtactaagattaacatcaataaaccgctatcttattttgacaattaataagcatattgggtgctggatgattatagataagttatgattatgataataaatgttgtaactcattgaacttatcaggaggtctcaaccatgtataaacgaatcctagtcccattagatggttccgataatgcttattatgcacttgaacatgcgattgccttagcgaaggtttttgactcccagttatttttattgaatgtcatcgatgttaatcgatttggcgtctacagtccagatgtttttacgagtgcggcgccagatatgatgagttttgatcaagcccagagtaagaaactgttggagcgggcccaggatcaagttgcagcccatcagttgcacgccgaaacaattcggcaaactggggtacccaaagtgacaattgcggtcgatgttcccaaggctcaaaatattgatttgatcgtgattggtcgctctgggactaatgcgatttctcgcctgttcttaggttcaacgacagcgtatgttgttcgtaatacggaggctaacgtcaccgttgttaacatgccgaatgatgaagctgaagaggttgaacaaaccggtgatgtttcggccgatgattctaaataacttgtcagtgatgattgaagctggtcacacgacgtcaacattgacgctcgtgcgaccagcctttttagtttgggataggcgatgacgaaaaaacaaagtcgttttccgctactgacgattaccgatttgagtgccaactgatgccgtttggctggcgtactggcttagtagctgattgcaggtgattagctgcaatcagtccaatgaatgtcagtgctaccgttaataccgctagggccataccggcggccgcttcaccttgttcgaacgattgatagataaatgttgaaacggtcgtcataccggaaggcagtaacaatagggcaacgactaattcacgactcgtggcaatgaaagccatcacaaagctgttgagtagcgcgggccatagaatcggaagtgcaatttttaggataatgcggccgaaactaggttcgaagatgcgtgcgctagccagcaattccgagtcaaaggccttgagggcggtcgtcaagtattgcaccgttgttggtagaaataaggtgacatccgcgatcaggaggatggttagggtgccgtataatttggtgaacgccagcacctgtgaaaagagcatcattaagctcaatgctaagacgacgtttggaattgcgagtggcaatgcgcccaaggtatgacataactgtcgcagccacttgggaaaacgttttgttaaactcccaacgctcaagaataaaccaacgatcacattgagactgctaatcagtaatgccaatccgacggtcgtaacaatggcctgccaggcaggactatcaaagcgtaagaggtctatatagtgtacaagtgtcaaattagacggactccaaccaagactgcgttgtttgagtagcgattggagcacgatggcactgaatggcaggacaatagcaatactgatgactagggtgacgaaagtgcctgctaatgttgtcactccaagctgccgatattgtgacgctgaccgttgtccggtgaacttaacagctggccggcgtaacaaccattgctggataccccaggcaatcagggcaatggtcagtaggagggtgccggtgagtaccccgttttggaaatctaagggccactggttgaggtccttttgaatcgtagtcgtcagaacttcgaagtggatgctccgaccaaaggtggctggcgttccaaattcagccaaggttttggtaaagactaaaatccatacagctaagtatgggactaacatgattggtaatgtgattcgcactagtcgttgccaggtgttgaccccatgaacttcggccgcttgaagccagcgctggttgaattgcatgagggctgcgcgtaagcctaagtatgccacgggatacaaatgcagactcatgataatgaccatcccgaacggtgaaaatagccactgaaattggtggtgccaactcggattaagctgagccagtaatccgtgtggttgaaagaaatataaccagcccatcgcgttaatatatggtggtgtcatgaatggcactaacaagagccaatgcaaccaggcgagctttgttaaacgggtgtgcgtcatgatccatgccaaaggggtggctagcagggttgtcccgacgaccgtgcccccaactgaggaacagactgtgttgaatgctcacacggttggttggctgcgtcagttgtgaccatagctggcttggcgattgcccgactagtgtttgaccaatcagggcgactaacgggccgataatcagagttgccaacaagcaactggtgatgattgataaggacaagcggatttgatgattactcattggctaaagacctgattgaatgcgacaacgtttttagtcagggccgcgttggcactggtccaattgaccgtgtaggctttgatggcttcgccattgcgtggatcggtcaaagtgctcgtggtacccggaattaagttacttttttgaatttgtctttgaactttagctgataagagatagtcaataaattgtttggcagcggcttgatgacgactagccttcaaaatcatcgccggtcgtggattgaccaaagtcccactcttaggataaacgaaaccaattttttcgccttttttaatagctgttagactcatgtaatcgaccccaccaaagacggcgattttttggccagtgatgactgcatcgagtacttccttgttagcacccccgatatcggcaccgttttcttgaagggctttaagtagttgcgtaccgtgtttcatttgataagcgttaatgaagtccaagctagaaccagaggtttgggggtccggaatggtcacttgattgcgatacggagtggttgtcaagtcagaccagtctgtcggtgccgatttgatgtgctgcgtattgtaggtgatgccgactgccgaagcactgtaattgatcaactggtggctagtatctttaaattgtttattcaggtgtttagcttgagaaggctgataggttaatagctggccattcttttgtaaatcgacgccagcggccattgaagctaaaatcagcacatcagcttggggattgccttgctcggtcttgaccttacttaaaattttcccggtcgtgccgtcaaaacttttgactttaatgccagttttggcttcaaaaccgtggatgatttgatcagaaaggggtttaggtccagcagcgtatactgttaagacttgttgactggtttgcgcattggcggttaacgtttttttctgatgttgattaacataaagcgacgtgccaattgcgagcacgccgagcgtggataatgtgataattgctgctttagacatgtgagtcaactcctaaaaagttagtatttgatgtggatcgatgcttaatgtgatcggtgcagtggtatagggtagctgggtcttgacgtgccaatcataggcgccgacttgaacgtaagtatcaaaatgatcgcccataaaggttgaacgctgcaccaagccttggtaagtgggctgctgagtacccgtttgactgactgcgacatattccgggcgaatggcctggtgcgcgttgatctgattaagggtgcccataaaattggcgacaaattgagattttggctgttggtacagctgtgctggtgtgcccgtctgcaccacgttgcccccttgcagtaatacgaggtggtcggcaacttgcaaggcttctggacggtcgtgagttacaaagatggccgtcagatgctggtcgtgaatcagggcgcgaatttctaattgaagccgtgtgcgcagttcggggtcaagcgcacttaaagcttcgtcgaataaaatcaaatccggttgggtcgctagtgcccgtgcaagggcgacccgttgctgttgcccgccagaaagttcacgtggataacgatgtcggaagtcaatcagactaacttgttcgagggcccagttgacttgagcagtcaattccggcttggtcagatgcttttctaaagcgaaagcgacattttcttggaccgtcatgtgcggccacagggcaaagtcttgaaaaaccatcgccaagtgccgctgggcagggggctgattccaatgagtcgcggcgtcaaaaatgggctgattatcaaatgaaatttgaccactgtcaggtgtcgtgagacccgcaatcatgtttaagagcgttgatttgccggaaccggacgggccaattaatgccgtgatttgttgatcaggaatcgtcagactgagttgattgattaccggaccttgaaaacttttggataattcgtgtagcttaatggcaaccacgatatgcaactcctttgtcttaattggtttgctcagtttattaagttactttgtattgtagtggtaattcgccgtgttaacgttgattttgagtttagtttatgtaaactttgtgtgttatttcggtaaaacagtgcacataaaaaaagaccactgaatcgaattcagtggtcttgggtgattcttattgtccttcagtcgtgttattggtatcagcggtcggtgtttccgatgaagtcgcttcggaacttgcttcggagcttgaactggcttccgaactactgctactttctgaactagattcagaagatgaactttcggcgctacttgaggaagaagcagcttcggaactactactgctactttccgaactacgactacttgcttctgtgctggtgcttgaactacccgttgttgttgaactagagctagctgaactagcggttcctgacgaggcttcactactggagaagaggtgaccaacaacgtaaagttcttcgataccgttcttcttagtcgtgccaactgagcttggtttggtccaatcagagtttggtgaatactgttgaaggtaattcatcatggcgcgataaatttgttgtgaaatcttttcgttggaggtatctagataaccaccagcttcggtggacttatcatagccagtccaaacggcgaccgaataattcttcgtgtaaccggccatccatgagtcaacgacggcatcggatggtactttgtttttatactgagaagcatagttgtcagtaccagtcttaccagcttggtaaacgccgctgatcttagcggttgtcgccgtcccagtagaactattgatgacccctttcagcatatcagtaatcatgtatgccgttgatttcttcatggcgcgcttaccagtgctagtatacgatgtcgtaacgccatcagaagtagtcactttacggatgtagtatggcttatgataaacaccaccgttggcgaacgcagcgtaggcaccggcaacttgtaaggtggaaacaccagcaccgatcccgttggcatagttaacggttttgaggttcatcccaaggttattggcaaaggttttggctcggcttttaccaacggcttgtaaggcccgaattgctgggatgttccgtgattgaaccagtgcttcacgcatcgtcatattgcccaagtaattattgtcaaagtcatgcacggaaatgttagtcccgggatatttgtatttcgtatcagacaacgacttgtaagttggccaattcaaatattcaatggctggtccataatcgagaatcggtttcatcgtcgaagcgtttgagcgtgatgtccagacagctcggttggttccgtacgtgacattaccggttttccgaccaccaatcatagctgagaccttgccagtgtatgagtcaacaaccgatacccctaattggaaagtctgttttccattattaggatagttgacgtattgagacgtgttggcaatgtcataaagccgtttctgggcatccatgtcaatgttcgtataaactttctcgccatcggttaaattataaccttttttgaggaggtcttgacggacttcgttcaggtaagcatccaagattttatttgtcttttcatgcttcgctaggcttgaacgtcccgaactagttaagcccgtcttgacactgactttttcagcagcagtttcctgactcttggagatgaccttgttatcgtacatcgcttccagcaccagattacggcggctagttgcgtatgatggataagtcgtcgggtcgtagtaggttggtgattgcggcatacctgcgagcagtgcgagttgactaaggctcagatcttttaatgacttaccgtaataatacttggcggcagtccccataccataaatcccgttacccatatagaccttattgatgtaaaattccagaatctgagatttactgtaatgtttttcaagattaagcgcaatccaggcttcctgcgctttgactttcaaatttcgatccgaagtactggtggaaaagaccgcaagtttaacgagttgcatggtcaaggtactcccaccttgcatcccaagtgagctaccttttaagttgccgactgcagccccaagaatccggtaataatcgacccccttatgcttgtaaaaacggcgatcttcgattgagacgacggcattcttaagtgtggatgggatattactagacttaacgtattcgtggtcgttagttcccaaagaggtcaaatacttgtcgttctggtcataaatcttagcggtccccgtattgacaaggtcactctgtttgactgttggtgccgtctgcgcatagtagaagaaaagtgctagaccagcgagtaccccgatgacaaacagtgcagctaaggataaaataatccgccgaaaccagtgtttcttaggtggtttaggttggctttttctgcgagcaacccgtgagttctgttcattgttacctgccatgatgttctcctttaatgaattgatgaggtctcatcaataatatgatcaagcgcatccaaatagggaatgcgtggattgatttgataatgtagctccgcggctaaatgttcaatatccgtcagtggaattgacttgcgaccaccatctccttgatgatcccaataagtaaataagtcgctggctgttaacaaaaataggcgccccaaactcgcaaaccgaatgataacaaaacagattccgctttgagctaagcactggcgcatgtgcttaatttgatgctcatgaaagttttttagcggaaaagccgttttgttcttggtctccttggcctcaaaatctaaatacttcccccgatagacaccgttataatcagtagtagaagcctgtttaaaataagcttcgcggattacagcggcgctgcgtttgggataatcgactttaacgatttgaatgggcgttggctttttatgaataactgcgatattattttcaagataataggcgttactatcattgatttcttgttccaagctcattccacgatcgccaaaattgacgttggcaaatttggaagatttcgatttagttgggccgggttggcgataaacttgaccgtttggatagcgaatcgtcacattaatcaacctcctaataatgttacattttaccattaactaatagggaatgtgaaatatctgtgagtttttaactgatttagaccgatttagtgacagaaaggagacttttttatgagccggttgtggcttagtggttaccggagttacgagttgaatgtctttggtgatcaggatgataaactaaaagttattaagtttgcgttaactaattacttaacgacgcagatcgaggatggtatggattggctgataacgggtggtcagctcggtattgaacagtggacagcggaagtagggttaacgctcaaaaagacatatccagaattgaaagtggcaatgatgttaccatatggtgaatttggtgggcgctggaatgaaaataaccaagctaaattacagactttgctggcccaagtcgattttcatgcaccagtcagtaaacaaccgtatgaaaatccgcaacaattaaaaaattaccaagaatttatggttacccatacggatgcggccactctggtatatgatccagataaccccgggaaacccacgtatgactatgatttgattcggaactttagtgacactcatccgtacccattgaccctgatcgacttcgactggttacaggaaagtgccaatgaatatgcagaaaaacagaataatggttttaattttgaataaagtctgctacaatgttttaagtaatgcggatgccgaatgggtatcgcgcgaataacaatgaggtgtttttaaatatggctaaacgtaattttactcccaaagacatccttcaaaaagagtttaagccaaagatgcggggttatgatcctgccgacgtggacggcttcttagataatgtcattaaggactatgagtcatttactaaagataaccaacaactttcagatgaaaatgaacggttacgggccaaggttgacgagcttaccaagcaagtcgctgtcggtgcaaccagtccatcttctcaaccgactagtacggtgacgaatatggatattctgaaacgtttgtctaacttggaacgtcatgtctttggtgcccaattagataataatcaaaatgaatcacaccgtctataattgtgattcgatgtaaattctgggtaatcgcggtcggcttatgtcggctgaggaaggtccatgctcgcacaagctgcgatgcttgtagtgttcgtgctcggtgaaaaaataagccggggtaccgatttatcggtaacggcggaaaaaacggctaaggcttcggctatgcccgagtattcctgaaaagtgccacagtgacgatactcaattggaaacggttgagttggaacgcggtaaaccccacgagcgggcaacccaaactacggtaggggcgcttcacataaggaactgaactaaatgtggggggagattagtaatctcgagatagatgattaccgcctagttaacagaccctgtactttaactaggtacaaaacatggcctacaggaatttacatttagacaggagactgggacaaaagttcgcttttgtcccagtttttttattcgatcagttagcaaactagcaacttatgctaaactaggtgaggaaaccaatttagtggaaatatttactcaacaagatacgcctacagaacaggcgtcgcaggaggaaactatgcaagaatttagattaattgccaccgccgctagcggaattgaagcattagtggggcgtgaattacgagatttagggtatcaagttcaaactgaaaatggccgggttcgatttaacggaacgatcaaagatattttgcggaccaacttgtggttacgaacggctgatcgaatcaagatcatcgttggtgaatttgatgcttatacgttcgatgagttgtttgaaaagactctcgcattgccatgggaccagttattgccgatggacgctgaatttccagttgaaggtaaatcgcgcaactctaaactccacagtgttcccgacgtgcagtctatcgtcaaaaaggcgatcgttaatcagttagccgatacttatcatcggagcgggcaccttccggagacaggcgctttgttcccattagaagtggctattaataaggatcacgtgttgttaacgctggatacaactggctctagtttattcaaacggggttaccgagtcgaaaaggggggcgcacccttaaaagaaaacatggccgctgccttagtgatgctagctaagtggtatccggataatccatttgttgatccagtttgtggttcggggacgattccaatcgaagccgctttactggcgcgcaacattgccccggggttcaaccgcgcatttgcgtgcgaaaagtgggactgggttcccgctggcctgagtcaacaattgagagacgaagctgatagtttagccgattacgacactgagctggatattagtgggtatgatattgacggtaaaatgattgatatcgccaagctgaatgcgcgggaagccgggctgttgcatgacattcatttcaaacaactggctgtcaaagactttacgactgacaagatcaacggggtcctaattgcgaacccaccatatggggagcggctaagcgatcgagatagtgtccggattctctatcggcaaatgggccaagtttacagtaaattgccaagttggagcaagtatatcttgaccagtgacttagaatttgaagacttctatggacaaaaagccacgaaacgccggaaactctataacggtgcgttacggacagattatttccaatattggggcaaacgaattcggccagcacggacggaataagcaagcgacctttgttggtaaaagtaggtgaaaaatattggcaaatgaaataccgcggtctgaagttgattcccagcagctattagtatttaaagtgctggctgacgtggttagactgaacattgttaagtatttgaagctgcaggatcaggccgttacttgtgggcaagtcggacaagcaatggggattagtaaaaccgctggttcatatcattttaaattgctggaaaaagcaggattaataaccgtcaaaaaagttgcacgtgaaaaatacgtcatgttgaaccccaaaacttttgatcactatgttacccatttttatcaaagcctttaaattgctgagtattttgggcggtcttcaactgtgattctgactaataccagttcttaagtgccgattggtcttttgaactggtatttttttgttgccgaatcgttagtgggatggtacgctgtaatagttcaaaaatatttgaactattgtgggtggccacccaactaaatctaagaaaaagattgacatagtagatttaaactttgtgagtaggcttattcagcattggtaagtctgaataaatgataatggggcggaaaacatggaaaatcgacagcgacagtttggctggttattagcgttaacttcattaggcttttttatggcaatgatggactcaatgattgtgacaacggcgtcaacagcaattaaaattgatttcgacatctcggaggccagtttacagtgggccctcaacgcttacaatgtcgcgattgcagcaacgttacttgtgggcgttgcattaggtgatcgctttggacgccgccgggtttataatctcggcattttagtttttacgctgggttcagtgttttgtgcattagccaatcgaatgccattattgatagtggcacgtgtcattgcaggtattggggcctccgtcatgacaccgatgtcaatggctattttaacggctgcagttccagttgcgaagcgtgggaaagctttaggaatctggagcggtatcggtggactggcactgattgtcgggccggctctgggtggtctaattgtagctaaattaacctggcagtggattttttggatcaatgtgccacttggcctgattgtcataggattatcccggttctatttaccagaaagtaccggggtagcaacaccaattaatttaacggacgcaggtctttcaatgttagcgatgaccgcaatcatttgggccttagctgccagttcgactagtattaatggaattggtccgttcgttggcctgataattggcttagttgcaggcacttggtttatcaagcgacagcaacatgtcgttgcaccgttaatgccgttaacgctttttaaaaagcgtatttttacgatgggaaatgtggcgacttttttattatatgccgcgatgtacggagtcgttttctttttaccccaattcttacaagttgttcagcatgataatgcgtgggaggcaggattgtccttattaccttggactgggacactagtattagttgcgccatttgctggcaaagctgtggacctctacggggaagcgattgtggcagttatcgggctattatctcaaacatttgggtatttcatgcttggttacctagttgccaaccatgcggcttatgttatgatgattgctccgctggcaattgctgggatgggattgtcaatggcgggccccgcgttacagcatgcagttttggggggagtgtcaccggcagttatcggtaaggcagccggaatttacaacgtttttcggttacttggaggtgcggctggcacggcaattgctgtggtggtgtttacagtgggtagtcgggtacccgcgatgaatgcaattggctttcaaacagtcatgtttagtacagcattgatttcagctataggcgccggttgtgcttggcaaataagaaattcaaagaacttgtagctgacaataacgatcattacaatgtgtgacagatagtttgagtagccttaaaagagcgtgtttaatcgggtgaccgactaagcacgctcttttaaggctaacgttaaccatggttgagcctttgataattaatttaaataataatcgaagaaattagcaactttgttcatcagaggcactttgaccagatgtttggcttgataacccgtgataaatgccacttgttcagcatacggggcggtatgcacgcggtcaaagaaattacgagactgtgaataaggaatccgttcatcctcagtaccatgccaaaataaaagtggccgatgattgatggtttccggttgcaggttaagatcatagtgatctagccaactcgtcaatagggctaaatcactgggaatgtaataagcatgggcctgcgcatgcttgcggactagttgggcgtacgcgttcaggttaggggtccccataatgattgtggctgctttaatttcaggatgatgggtcaataaagccccagtcgtcatgccacccattgagtaaccgccaacaccaatctgctcattcaaaatgagtttgcgctcccggtagtaattcacaattagctcgaattcgccaagattaccttggatactgttccaaaaagtaaatgaaggaatctggctaacgatttggtgtcgttcaccgtgattcatggcatcgggcaagacgactcgtaaattcttgcgagccagtttacgtgcttgggtcaagacgagttctttattggactgccaaccgtggtaaaaaaatcactagtggcagcggttggtctaaatgggttgtagtaacaacttccagcgcaggcacatcttgaaagtgtcggttagtaactttgatcatatttatcggctcactttattaatattatgattaagttaactgtgccagaaatgactgctgaatacaactgatagacttgtttagtcaatatttggtcttgttaattgttagtgatgttaaaataatggtaatcgcctgtttattaactagaattacggcctctaaaaagtaatcttaaaacggaaggtgttataaatgaccgaaatcgaaacggcactacttcgggaccgaaaagcaaaagtccagcaatattttgcgatgtgggtcactcgtgattttgaagcgttaccaagaatatttgcggtcgattgttattatcaagaatgctatggaccagcatatctatcattagcggaagttcaagcctggattgaacatcaattaagagttcaacgggtaacggcgtggtcgattcagcggttgtggtcagcaactgacaacatgatctttgcccagtggtccttcaccgctgttactgaccggatgactcagtttgatgggctttcagcagttcattttaatttagcagaacgtatcgacgatttacgagagtatcagaccacgactgcgcatgattatccctatcatggatccgtgctgtgatatgcgaagcatgtgtgtcataatgtaagcgaaatcatttggagtgttgggggaatcagtatgcaagttcaagtttctgttattgtggctgcgtataatgaggagcactggttaaggcgttgtttgacctcattaaaaaaacagacattagcggccttagaagtcattattgttgatgatggtagtacggacggcacggctacaatttgtgaccaatattgtgcgcgctggccgcacctatttcgggttatccatcaacgtaaccaaggacagggacctgcacgtaatgcggggattaccgccgcgcatggccgctatttaggttttgtcgatgctgatgattgggtcgaaccgacgatgtatgcgaccttagtagcaacggctgagcgtagtcatgcccaaatcgtcgtttgtgatgttcgtaaaatctacgcggcgactcaccgcacaactagtctgctgagcttgccagatgcgactgagcacgtggcaattgcgacttatcttaaatacggtctaaataatgcttattccggaaataaattatatgcacgttcgtgttggcagaaatatcgttaccagcggatggtctacgaggatttagatattttgctggacatgttgagttactgtgagcgagtcgcctatgtgcaacaaccattttataattattataaacatgctggttcgacaactttagattataccaacccacgactgtttgatattatgacagcctatcaagatgccattgagcacgccaaggtgacgtatcaggatgcggtgacttattgcgtcgctaagcgaattttgattaatttagcaacgccaggctttgccgattatctagcggagtttattgaactgatacgacaattgcgtcctatttttgaagccagtccgtcaataatgagtgatccggctattaaaaaagtttgtgattatgcaggtcaattgacattaccccggcgatttatctgtgagcgtgaggactgggctcaatcgtggcatcagtatagtcggaatttcaaaacgattataccggtagctaaagcattgccggccgatttacgacaacggtctaaccactttaaactcgattattggttgttgaaaacgttatttgaacaaggtggcttgctgattttgggtaccgtcaagttgcaccgcccgtttggccgtttacgggcgggaggtgacgtgttagcctttgaaggtgaacattgtttattagttggtgcgcaaccacgttccccactgatttctgaattactgcaacagttgattgttggttccgagtcactaacagagttgctgacaatggttaaggcacagccagaacgatggtcagcgggtacgcataagattcgcttggttgacataaaagattggctacaatagggcgacgggtcactgagtcatgcagagcagcggactcagtgacctatttagtcgttggttacattgaaaatgaataaaaaccaaataacaatttaaaatattatataatgatgataaaattaattttaaattaaattaggaaagggtgagaatatgttaaaaccagcaccattgcacgttggtgatcacgtggctgtcgtcagtctttcgagtggcacgctcggagaactcacgcagcaacatcaattgaatcgggggctaaaacggatgcgccaactagggctcgtcccagtcatgatgccgaatgctttgaaagggcgactgattttacagcaacgccctgaattaagagccgccgatttgaagacggctttcttagacccaagtatccgtggagttgtggcggcaattggcggtgatgatacgtatcgaaccgtgccatttttgatggctgatgagcagtttaagacggcggttcggcggtcgcctaaactgtttacaggcttttcagatacgacgatcaatcatttgatgttttatcagcttggactgcaaactttttatggccccaatttcttaagcgacttggccgaattagggccgacgatgttgccgtataccacgaagacttggcagcgttactttgaaaatcctcagcagacaagcattattagcagtcctgtgtggtatgacgaacgaacaaatttcagtgaatcggcgcagggaacacggcgcatgacccacaccgaaatgcaccattacgaagtgttacgtggtcacgggacaatcagtgggacgctacttggtggttgtctggacagcttttatgatttattgaccacgacccgttatccagacgaacggcaagttgcggaacagttcagactgattccatgtgcagccgaatggcgcggaaaaattctgtttatcgaaacgagtgacgaacagccgcagccagatttgttcaagcggatgctgcaacgaatgcgacaagctgagattttgacaaacgtagccgccgtgattgtaggtaagccgcagaatgagcattattatcaggaataccgccaaattttgatcgatgagacagccgatttgaaattgccaattctgtacaatattaattttggtcacgcttttccgcgaacggcacttccatatggggcgcaagtgtgtatcgattttgagcaagctacgttaaaaattttagaaccttggtttgtggaagcttaagtggttattgttaaattggtatcggcagacgatcaaaaaggtattcgttgttcattgcaacgagcaaagaatagtgcaatacgagaggagttgtcatatgcaattacaaattcgacgttttaaaactacggatgcgccagcagcggcggcactgattgcgcgcacattactgacgagtaatcagggtgactatcccaaagcatacttggatcggctcattacccagatgacaccggcttggctatgccaaaaagctgctgcgacgcacttttatgtcggttattttcagcagcaactcgttgcgaccggggcgattgggtcatactgggggcgcccaggtgagtacagcctgttcacgatttttgttgatccggaggttcaaggcatgggtggtgggcgtcaaattctgcatacccttgaacaggatgtctatttcagtcatgcccaccgtgtagaaattccagcgtccgtgactgcgcacttattttaccaacacttcgggtatcgacctaagcctggaggaatctacccggatgatgaaggcctatatcgattagaaaagtttccacatgaatcattttactagggtccgtcttaaaacnnnnnnnnnnttttcagacagtccctagtaaatcacactttcctgcattagtttataatgtaaacaaattgtaaagcgactgcaatcagttggagaacttatctgcacattttatcggtaggataaggtgtgcagtaaacgtacatatcaaactaatgatgggaaggcgagtaatttggtcatgcagaaaaagtggcggttgatactgctgctcgtgggttgttttttaggtggtaccggagtcgttcaggcacacgcggcggtgccggatatctcagagtggcaaggtcagttaacgagtaccgaggttcaaagtttgaagagtcaggctgattttgtcatcaaccgggtgcaatatgggagcagttatgaggctctctaccacacctctaatgagagtctctatgtgaaatatggtgttccgttcgggtcctatgactatgcgacctttacgagtaccgcgactgccaaagccgaggcagataagttctatcaacgcgcaaataagaacacgaagttctacgtcttggattttgaaacgacttccatgagtagcacggcggccaacgcggctgtcaaggcttggtatactgagatgcggtcgttaacgagcaagaagttgattttttattcgtaccagtcatttgcaaccacatacgccaacacggcacggcaaagttttgatgcccagtggattgcaaattactcctcgaagccgacgatttcgttctcattgtggcaatattccagtagctattatttatcttcgctaggacaatatgttgataacagtttgtatgacagtgcttccgtgacgacataccacccgttaagctggtggacttccgggacttcgacatcatcgtcgaccagttcaactagcacgacgtatgcctacagcagttatacgaaagggcaacatgtgtacctcaataatggggcgtcgagctattatgacggcacaaaagtgcccagtagcgctaagaaaaaatactacaaggtcacagcaaccaagtcagtcactaagagtcgttccaaacagctggtttacttaagtggtctgaataaatgggtcttatcacaggacgtcaccggctattgggtcggccaacacggattatatcaacttcgtgaaaagagcactttgttcaaagatgttaatttgacaacctcgacgggtaaaaccttgaaaaagggtggcatctacagtggtaaattggttaaaagtgggaatttctatcgaattaaggtgagtggtggttatatcacggcgaaggtctccaaatctgatcattggtactatgaatcagtaccttccagtggctggatcaaggctaaagtgggactctacacctataaatcttcaaactttgttaagtctaatcgacacgcttaccacgccgctggtgatcgaattaaagtaacgaaggtttactcacggtcgggtggctcacgctattatttaacgaataaagggaattacgtttcagccaaccgctcaaacgtggtcacacaataagtcaattaagtcgctcaaaacgagcatagccagttgattactaaacgactttcagcaagttattagctgaaagtcgtttttttgaggaaatacgtcgattggaagtacgttaagattaaaaagtgctacacttattttaattatattttaatcttgtggggtgggaatacaatgaaaattgggacattttctgcatcaacgccgattacggcattatcgccaaaccgttatgctcgcgcacgacggttcttggcaacccaaggagtgaccttagttgccggtaatttgacgggacgacgggatagttaccgtgctggttccatcaaagaacgggcggccgaaatcaacgcgttaattcatgatgattcgctggacatcttgatggcaacgattggtgggacaaacgcaaattcggttctagcaatgctcgattacgagtatctcaatcagcatcccaaaacaattgttggttactccgatgcgacggccgtgttattggcggtgcaaacgcacgcgcctaactgtcgtgtgatttacggaccggccttagtagcctcacttggcgccttagagtcagagatcgtgacaactacttggcaaaattttctgacagtctaccgcgcagcaccggggcaggccgtaaccgaaccggcaccggcaccggcacagtggacggatgaagcgatcaattgggagacctttgaacatccgaaacacatgcacgcaaatacttggcattatacggcgacccccgttttggctggccgtttgatcggtgggaacttgaacaccatgtacggcttctttaactcaccttattttccaaaattaactggtaacgagcttttatttattgaagatgccgagaaaactgcagcaacgctggaaaaaaatttcgtaatgttagcgttggctggtgtttttgatcaaatctctggcattattttgggaaaacacgcgttgtacgatgatcaaggcagcgggcggttgccaatcgatatcttacaggaggtgctgggggatcgccaattaccaattatttacgactacgatagctgccatacagtccccatgctcagtacgccattgggggcggatgtccggattgatgcgcaggctcgaacggtgacgtttagtcatttttagactaccttttgcaattaaagacgtttagcaagctcaaaaactttgtaaattggccatacttacatgcctggtataagaatacttgctttttgataaatgataaacatataataaaacaattagattaacaaaaggggtgtgatggtgatgcacaaatatagtgttcaagtgggggtctacacgcagtatttttttaaggtcattcgggatactcccggggtgttaatttacacgatctgtttgccacttgtctttttaatcatgaatgtcagtagcgctttctttaaacctttatcgctgacaacttatacggctcaagtcgtgccctacattggttggatgattttttccaattgtctaacgactgccagcaatgtagccattcttcgcgagcagggttatctcaaacaatatcgaaccttggtggttagccctgcagtttttcttgtcagtcaagcgctggtcagcttgggtataattttgatgactttattgttggtggccctgttgagcgcgattactttcaagttggcctttttatcgttgctaggtcgcttatggttgactgtgttgcttacgtatctaccagtcacttgttttggcttacccttgattgccttggcactccgacgtaaaactgtcgatatgattggaaatgcactggcgctgatcgtcgtcgtaggtacctttatgttgagtaacatgctggcagtgtctgccaataacccattactcaacctggttagtcccatttacttagttaccaatgtttttgcgatgatcagcgtgggccccgtcagccactttatgacgacttatcttctgagtctgattgtattattggttatcggcggatttagctatcggcacattaagattctgccaacggagggcttataatgatgcgtgttgagcacttagcatattacttttcaagaaatgggcaaccgttcttcaaggacgtgagttttcaattaaaaagtcccggtgtcaattttttgattggtcaaaatggcgctggaaaaacgacgctggctgatatcatcactggtttgcggccggcacaaggtgaattagacctacctaaagcagccatttatttgaaccaacaactcccgttactgtcttcaattcgtgtgcgggacgttgcccaactggttttgggcatcgagcacggacgactacgattgacaactgaacagctccaacaacttattgatacccaagcttatcaattcttggccccgttgtgggatcagcattatggtcagctttctgggggccaacgcaaattagttcagttattgctgttcttacaagttgatcgcgaattgattgttttggatgaaccaacagcagcggtcgatcgggaaaacgtgcagttgttgtttcaggtcatgcaagcccatcctgagcgaacctacttgatgattacacatgacgttcgcgaccttcatgcttttacagattaccaagtgctgtggctcaatgatcggcaggtgacgacactgtccaagcgaacgtttgaagctgcgagcgcgcaagctgactttgttgcgctcttcaaaacgcagtaatataacagtaatggctcttgcgccgcaatggcgacacttattttgagtcctttggcgctcaagttggcctcgctggcaagtctcataaaatgacactaaaaaacggtactcagattagtttgagtaccgttttgcgtattattggtgagcgtacctagccaaagtaataaatataaccgatgatcaatgcccagataacgatccataaaatactgaatgccaacttgaagtaatacaaatgaaaacgaaaacgacggaagcggtcgctaccggccaatttgaacgtcaaggtcttgttatctaataattgcaagtaatcatagaaacggggaagccacacaccgcccgttgttaacacgattaacaatccgatgatggcaaacgccgctgcggggtaaacgatactggtatcgaccgtaaaggccggtgcaagaatgttggcatataacaaccataaagcatacaaccccaacgcgtaaccaataatccgaacaacattaacgataattagccgtgactttaagtccggttgttgttgcatgagtgcctgattcgcatgataatgctgggtgccaaagcgcccgctgaccggaatcaagtatcggttttgatgtaagtatggcagttgtgctaacagcgtgatcaatgccacaactggtacggcgattgccaccaccattagtaggtactcaatagtgaccatgggaacggtgctgacccggtaggcccaactaatccaaccaatcaggatgaagacgtctaatgccaaaaccaaccaaatctgaaagcgacgatagtgttcgaacgtggcggtatcggctagctgccaatgatggtcttgagttgagtgaccaatcaagtaatcataactttgcgtcggccacactaaggcaggaatcattagcaagatgatgccaacgatcattaaggcgatgcttgtgacaacactccgaatcggaaaaatcaacagggttaattttgcgctgaccaagtagcaactgactagtaaactgataacaccgagccaccagcaagctgccattccataatataaccatttcaatcgtggtgcttgatcggtcacgtgttgccgcacttgatgttgcaattggagctgtgcgcgcggcgccaggtttttagctggctggatgaccggatgctgaagattgtggtattccaaccaacccatgagccctaacaataaaactaaaagaatccaaacaataactaacatggcaaaagtcctttaaaacaatatagtcgtgcgtattaataagtgtaaaacgaaaatatggtcaaaatgtgacgattatttaaatcttgtaacttttttaatggtcagttgatttaacgaagcggttaaaaaccattttctactgatcagttgtggactagactatgcatgactgattgtaaagctgtgttttatctgtaataaaaagcatttggaactacttacgatgtctgtcattgtgggaggaaagtaatcatgaatcaattaatgacggaattgggacaagtgtactatcagtaccgaccggcgggaccacaacagccgacgttgatgtgcttaccggcgtttggctgggacgccactgattataattttaagcatttaatggcacgattggtgtgggccatagcattcatagtcaaatggtgcgcactgtcccgcatattttagccaatcttgaggatgtggttcaccatgaacacgtgagcaacttattattggtgggccacagtttaggcgctagttacgcgttcttatatgcccagcagcacttagacaatgtttgtggcttagttttgcttgaaccaccctatgccgcgatggcaccacaacttcttgcaaacgtccaatcttttattgaaaactatccgcaactagtacaacagcgacaaactttgacacttcagcaactcttagcagaagttaatcctttaaacctactggcagaacgtgtcgccaatgcccgtattgatttagcagcttacgcgaacccgagtattctgactgaagcgcaatgcttaccacaattagtaacgacgcttcgaaccgctgaaaagcgggtactgacgctgccaatccaagttttagtcactgaccaacgcttgacggcgtaccaacaatcaccgtggtgccagcttggtcacctagttcatgcaccaggtcagcattatttacactggacgaacgaaaattttgtccggcaacaactattgattgctctgtcccagtcatagggggcaaagagccagtccacggtattaaattaatcgctgcaaagctagtactagcaacatctaccaatggtctgactttaatccaactgaatcagccacccgcaacaaattcgagtatgctaaaatgaaagcagattggttgtggaggcgttggaaaatgcaaaaacaagtaacgattattggtagtggcattgttggggcggtcacggcgtactatttaagccagaaccctgacctgaacgtcacgatttatgatgaaggtattggtcaagcgactaagaattcagcagggattatttcaccttggttatccaaacgtcgtaatcagcgttggtatcaactcgctaaggccggggctgctttgtatccggaaattgttgcggacacgcaaatgggctattctgtttatcaacaagcaggaacgattgtgactcgtgccgatccagatgatctgcaggcgctatacgatttagctctaaagcgccggcaagcggcaccccagatgggaacgattgagaaattaactgctgaagaagtccaagaacggatcccactgctaacggcgccccaacccggtgtgtttgtgagtggtggtgcgcgggtcgatggcgataagtttgcacataatttactgaaatacgctgaaaagcggaacctggtccgtcataaaggtaaggtacgtttaggtgaccagggccaactattgacggttaatggtcagcaaagctatgacacgttgattttagcagtcggggcgtggctaaagccgttattgttgccaatgaagattgttgcggatgttcggccacaaaaagggcagttgattgaaatgcagctacctgagacttgggctgacgatgttccagtgctcatgcctgaaggtgaacgagactttattccctttacgcgcagcaaattggtcgttggggcgacgcacgaaaatgatcagggctacgatttgcaggtttcaagtctggttgaagatgatctctttgctagcgggctcaaacttgatgccaacctgactaaggatcaaattacgcaggtaaaagtgggtacgcgtgcctacacgcgtgactttgcgccgttcttcggtccaattccggataacccacatattttggtagctagcgggttaggttcatctggtttaacaacaggacccatgattggtaagctgttagccgattatgttcaaactggtgctcatgactgggaccagtatcaacgatcaattgaaacttatttggccccggctgattagtcactaagatgtaagccttgttgtgctaattgatgggcgccatggttatcactttcggcaatccactgggtgattactaattggcactggtcttgcaggtgcagcaaagtcgccagctcgacactgaaagttttgctgtaacccttggcgacactttcggcgacgatttgactatccgtatagaaaaagacgctgacttgcggaccataagaatctaataaagttttaaagccagcaatggcggcaagaaattctgcggtatgattatcactgtctggcaagacctgtttgaattggtgttgttggccctgatcaataattaagattcccgcggcactgcgctgattatcgggtgtggtcgcggcatccgtatataattgcatcaaactcactccaatgtgaaaggaattttgtactgtgaataacgataagcatacctttaaataccaaccaatgctagcgtcaagtgttatcgtctggtcgtggacggcactagtattgatggcggggattattttgtggctagaaatcttgaagtttaagtggtggttactcgtcattgcggcgctctttattgccttggtcgcgattcaaatcagcttgcggcgcgtaacaatcaatcataacctcattatttttagcacggtcttgaaccattcttggcttgtgattccccgtgatcaactcgaattgatcgtcccgatacgcggtgggttgaaagttcaaatcgatggtaatcaatatcggtttttgatgttgaaaaaggcgcgcaatcagttgattggcctagcaactagtcgatagatacgaataaaaacaatcaatatacaaataatgttcataatttcaggaagattgttataatggagtaagtaaaaacagaagggcggagaattgatgaaggatattgaaattgcacagcaagtgataccagaaccgattacggcgattgcggctaaagcgggcttgacggttgaccagatcgaccaatatgggagcacgaaggctaaacttaaattaccgttaccagttaagaaaactcaacgcaaccttattttagtaacgtcgattaacccgacgcctgctggtgaaggaaagtcaaccgtgactattgggttaggtgacgcgttgactaagattggtaagtcaacgatgattgcattgcgggaaccttcattaggaccagttatggggatgaagggtggcgccactggtggcgggtactcacaagtgattccaatggaagatatcaatttgcacttcaccggcgacatgcatgccctgacggctgcgaacaacacgctcgcggccttaattgacaaccatattcaacaaggtaaccagttgggtatcgatcagcgtcgaattcaatggaagcgcgcgttggatattaatgatcgggcgctccggcatacggtgattggccttggtggtgcaacgtcgggtgtacctcgtgaagatgggtttgacattaccgtcgcgagtgaactgatggccattctctgtctttcagaaaatatcgcggacttgaaacaacgtgttaatcgaattgtaattggctacacacatgaccgtcaaccagtgacagttgctgatttgaacgtcggtggcgcgatcacgttacttttgaaagacgcgttacgtccaaatttagttcaaaccctggcgcataccccggcactcgttcatggtggtccgttcgccaatatcgcgcatggttgtaacagtgtacttgccacgcaagccggattgaatctagccgactatacggtaaccgaggcgggcttcggtgctgatttgggtggtcagaaattcatggatattaacgtgccagcggtcggacaagcgcccaatgccgtggtaatcgtggcgacgattcgggctttaaagttacatggtggcgtggctttgcaagatttggcaaccgaaaatgtggcggccttgaaagccggtgcggctaatttaggacatcatatccatgccatgcaacgttatggggtgccagtcgtggtggccatcaacgaatttacggccgatactgacgccgaaatccaagccgtcaaagactattgtgccgaccttggagtcgatgcagtcttggctgatgtctggggtcgtgggggtgacggggcaaccgacttagctgccgcagtggttgatttatgtgctcagccaagtcattttcaaccgttatcaccagcggatgcggatcttaagacgaaaatcaacgatattgtcactaagacgtatggtggagccaatgtcgaatattcagcgaaagctcagcgccaattgagaacgtttgctaagcaagggtgggatcatttgccagtctgcatggcgaagacgcaatactcattgagcgatgatcccaaacgtctcggagcaccaaccggatttacaattaatgttcgtgaatttgtgccgaagttaggtgcgggtttcattgtcgctttgaccgggaatgtgttgacgatgccgggactgccaaaacatccggccgcactcgatatggacattagtgatgatggaaaaatctcaggtttgttctaaagcttgaccgataagtcgatgctagtgggggtcggctttttatttgcgttgtttttggaagactgcgacagcgaatcaatcacacacgtttaatttgtgagctaccgatgatgactaactcgcttagcagctgagcggtgcaaccaatcatcaggctcgttgcttcaactgggggatggttaaccaggtgccgatgcttttgggaggatactcgaaaggtgcttagttattaagtctgcaataaaaaccgcgcttttcctgccggagtttcgtacaaggacgacgtcttttggtataattaaacacagcttagcgaaatgtgaggacagaatatgtggatctatttaattttaatggtagcgctggtcattattgaccaagttatcaaagcagcgattgtgagtcatattgcgttgggtgccagtacgagtattgttaccgggttattatcactcacaaatttacataataacggggctgcttggagtatcttagaaggcaagatgtggttcttctacttgatttcagtgattgccttgatcgtgatgggctacttgctgtggcgcttacgtggcaaatggctatatgaggttggtatttcactgatgattgcgggaactttggggaatttcattgaccggttacgtattgggtacgtcgtcgatatgttccaacttgattttattaattttccaatttttaattttgcggattcatgtttaaccgtgggcgtcatttttatcttgatcggcgtgctgcgggatgatagttttgaaaaataagttacagggagctgataacgtggcaggagcgaccacggaacaacaattcacgattactgaccaaacagggcgcttggataaagtgttagcggcactacagtcggtctggacgcggtcgcaagttgataagctgatcaaaacggatcaggtgacggtcaatggtcagctcgaggcgagcaagtatcacgtcaaaccaggtgacgaaattgtcgttgccgcacagacggttcaacaaacaacgattgagccagaaaacattccattagacattgtttatgaagacgatgacgtcttggttgtcaataaacctcaggggatggtcgtgcatccagcccctgggcaccctaaccataccttggtgaatgccttgctgtatcatagtccgttgtcgacgatcaacggtgaatttcggccagggatcgttcatcgcatcgataaagatacatccggattattgatggtcgcaaaaaatgaccgggctcaccaatcgttggcggcccagctgaaggcgaaaactaacttacgagaatacgtcgcactcgttcacggagtgattaaagaggatacggggacaattaatgcgccacttggtcggtcaccgaaggatcgcaaaaagcaagccatcgttaagaccgggcgaccagcagtcacccattttaaagtactgaaacgttatcagcactatactttgattagttgccggctggagactggccgtacgcatcaaatccgcgttcatttacaatctattggacatccgctggtgggcgatcccctgtacggccccaaaaagacgattaaggggcacggtcaatttttacacgccaaattattgggattcaagcaccccgtaacgggtgacttattgacctttgaagcaccactaccaccaatctttacgacaaccttggctaagcttgacaaaaccgatgggaatcattaatctaacagtaatgagcgtcctttaatccggccctgcgagactgaaaggcaaactgttaacaataacttttcgtcgacggccgtgacaccttgtccggccgtctttctttgtcgtacgggttgctcaaaaaagcgataaccacaaattgggaggcaattatgcaaaaagaagttgttgattcaatggcgatgaaacgggcattgacccggatcacctatgaaattatcgaacagaacaaaggcattaaaaatgtcgtcttagtgggcgttaaaacccgcggcgtctatattgcgcagcggattgcagcccaattacaacagcttgaaggtactgcgattccagttggcgagttagacatcacggcatttcgtgatgatcagccgctggatcaagcacggctttcaacggactatcagttaacgttttcggtggcggataagcgggtcattttagtcgatgatgttctatttaccggccgaacaattcgcgcggctttagacgcattaatgggtggcggtcggccccagagcattgccttggcggtgctagtcgatcgtggtcaccgcgaattgccgattcgcgctgattttattggtcgcaacattcccaccgcgcgtcaagaacgcatcaaagtgacggtcaatgaaatcgacggtcacgatggtattgaaattattaactagtacgacaaagtcaaacagatgagaagggatcgcaatggcagaccgctatttgattcttgaagatggcagcgcctatttaggtgaaggctttggctcgccagcggtttctaccggagaaatcgtcgtcaacacgagtatgacgggctatcaagaaattattactaatcaaatttatcataatcaaatcgttgcttttacgcagccaaccattgggagctatgggatcaaccacgatagctacgaatcaattttaccgaccgttaagggggtcgttgttcgggatgttgctagcatttcgaccaaccggcagcggcgctggtcactggatcaatatttaaagcaacaaaatattcctggcatcagccatattgatacacggcacttagcgaagcaactccgagcaagtggcccgatgaaagccagtatcgtagacgttgcagatgcccatgcctttgatcaattgggtgcgaccgtgctgactaatcaacaggtggcagcggtcgcaacaccgaaaccatttcctaatccggggacggggctcaatgtcgtggtcatcgactttggcctcaaacacgggattttgcgcgaacttagtaagcgtgcttgtaacgtcacggtcttaccttatacggcaacgactgaggaaattttaaacttagatccagacggcgtcattctatcgactgggcccggcaaaccgcaggacttaccagccagtgtgactgagatgatcaagaacattcaaaatcgggtgccactgtttgccatcggactgggccacgaactatttgcgatggccaatggcgcccaaattatgaaattatcacctgaacatcatggggctaaccacccaatccgcgaagtgattacgaaccaaattatttatgcagctcagggccaggggttcgcggtagatgcggatac
